US007276593B2

(12) United States Patent
Vernet et al.

(10) Patent No.: US 7,276,593 B2
(45) Date of Patent: Oct. 2, 2007

(54) PROTEINS AND NUCLEIC ACIDS ENCODING SAME

(75) Inventors: Corine Vernet, North Branford, CT (US); Meera Patturajan, Branford, CT (US)

(73) Assignee: CuraGen Corporation, Branford, CT (US)

( * ) Notice: Subject to any disclaimer, the term of this patent is extended or adjusted under 35 U.S.C. 154(b) by 361 days.

(21) Appl. No.: 10/038,854

(22) Filed: Dec. 31, 2001

(65) Prior Publication Data

US 2004/0022781 A1   Feb. 5, 2004

Related U.S. Application Data

(60) Provisional application No. 60/333,350, filed on Nov. 26, 2001, provisional application No. 60/322,699, filed on Sep. 17, 2001, provisional application No. 60/313,325, filed on Aug. 17, 2001, provisional application No. 60/312,915, filed on Aug. 16, 2001, provisional application No. 60/294,080, filed on May 29, 2001, provisional application No. 60/286,683, filed on Apr. 25, 2001, provisional application No. 60/284,447, filed on Apr. 18, 2001, provisional application No. 60/283,889, filed on Apr. 13, 2001, provisional application No. 60/279,863, filed on Mar. 29, 2001, provisional application No. 60/279,833, filed on Mar. 29, 2001, provisional application No. 60/279,832, filed on Mar. 29, 2001, provisional application No. 60/269,814, filed on Feb. 20, 2001, provisional application No. 60/259,785, filed on Jan. 4, 2001, provisional application No. 60/259,415, filed on Jan. 2, 2001, provisional application No. 60/258,928, filed on Dec. 29, 2000.

(51) Int. Cl.
| | |
|---|---|
| *C07H 21/04* | (2006.01) |
| *C12Q 1/68* | (2006.01) |
| *C12N 15/00* | (2006.01) |
| *A61K 31/70* | (2006.01) |
| *C12P 21/06* | (2006.01) |

(52) U.S. Cl. ............... 536/23.5; 435/6; 435/320.1; 435/69.1; 514/44

(58) Field of Classification Search .............. None
See application file for complete search history.

(56) References Cited

U.S. PATENT DOCUMENTS 5,082,767 A * 1/1992 Hatfield et al. ............ 435/6

OTHER PUBLICATIONS

Sigma Catalog, Sigma ChemicalSigma Catalog, Sigma Chemical Company, p. 776, 1990.*
Attwood, Science, 290:471-473, 2000.*
Gerhold et al. BioEssay, 18(12):973-981, 1996.*
Lopez et al. Molecular Biology, 32:881-891, 1999.*
Russell et al. Journal of Molecular Biology, 244:332-350, 1994.*
Wells et al. Journal of Leukocyte Biology, 61(5):545-550, 1997.*
Oohashi et al., J. Cell Biol., vol. 145, No. 3, May 3, 1999, pp. 563-577.*
NCBI Website, AB025412, May 1999, pp. 1-4.*
Anderson, et al. (1991). "Cloning and expression of cDNA encoding human lysosomal acid lipase/cholesteryl ester hydrolase." *JBC* 266(33): 22479-84.
Amouyel, et al. (1994). "The apolipoprotein E alleles as major susceptibility factors for Creutzfeldt-Jakob disease. The French Research Group on Epidemiology of Human Spongiform Encephalopathies." *Lancet* 344(8933): 1315-8.
Anchors, et al. (1986). "ApoE deficiency: markedly decreased levels of cellular ApoE mRNA." *Biochem Biophys Res Commun* 134(2): 937-43.
Appella, et al. (1988). "Structure and function of epidermal growth factor-like regions in proteins." *FEBS Lett* 231(1): 1-4.
Asada, et al. (1996). "ApoE epsilon 4 allele and cognitive decline in patients with Alzheimer's disease." *Neurology* 47(2): 603.
Barker, et al. (1986). "[Similar domains in different proteins: detection and significance]." *Tanpakushitsu Kakusan Koso*(29 Suppl): 54-68.
Baumgartner and Chiquet-Ehrismann (1993). "Tena, a Drosophila gene related to tenascin, shows selective transcript localization." *Mech Dev* 40(3): 165-76.
Baumgartner, et al. (1994). "Tenm, a Drosophila gene related to tenascin, is a new pair-rule gene." *Embo J* 13(16): 3728-40.
Bennett, et al. (1995). "Evidence that the APOE locus influences rate of disease progression in late onset familial Alzheimer's Disease but is not causative." *Am J Med Genet* 60(1): 1-6.
Bersot, et al. (1983). "Cholesteryl ester accumulation in mouse peritoneal macrophages induced by beta-migrating very low density lipoproteins from patients with atypical dysbetalipoproteinemia." *J Clin Invest* 72(3): 1024-33.
Betard, et al. (1994). "Apo E allele frequencies in Alzheimer's disease Lewy body dementia, Alzheimer's disease with cerebrovascular disease and vascular dementia." *Neuroreport* 5(15): 1893-6.
Bickeboll r, et al. (1997). "Apolipoprotein E and Alzh imer disease: genotype-sp cific risks by ag and sex." *Am J Hum Genet* 60(2): 439-46.
Blennow, et al. (1994). "Cerebrospinal fluid apolipoprotein E is reduced in Alzheimer's disease." *Neuroreport* 5(18): 2534-6.
Blesa, et al. (1996). "High apolipoprotein E epsilon 4 allele frequency in age-related memory decline." *Ann Neurol* 39(4): 548-51.
Blomquist, et al. (1984). "Vaccinia virus 19-kilodalton protein: relationship to sevreal mammalian proteins, including two growth factors." *Proc Natl Acad Sci U S A* 81(23): 7363-7.

(Continued)

Primary Examiner—Marianne P. Allen
(74) Attorney, Agent, or Firm—Mei L. Benni

(57) ABSTRACT

Disclosed are polypeptides and nucleic acids encoding same. Also disclosed are vectors, host cells, antibodies and recombinant methods for producing the polypeptides and polynucleotides, as well as methods for using same.

7 Claims, No Drawings

OTHER PUBLICATIONS

Boerwinkle and Utermann (1988). "Simultaneous effects of the apolipoprotein E polymorphism on apolipoprotein E, apolipoprotein B, and cholesterol metabolism." *Am J Hum Genet* 42(1): 104-12.

Boisvert, et al. (1995). "Treatment of severe hypercholesterolemia in apolipoprotein E-dificient mice by bone marrow transplantation." *J Clin Invest* 96(2): 1118-24.

Borgaonkar, et al. (1993). "Linkage of late-onset Alzheimer's disease with apolipoprotein E type 4 on chromosome 19." *Lancet* 342(8871): 625.

Breslow, et al. (1982). "Studies of familial type III hyperlipoproteinemia using as a genetic marker the apoE phenotype E2/2." *J Lipid Res* 23(8): 1224-35.

Brown and Goldstein (1983). "Lipoprotein receptors in the liver. Control signals for plasma cholesterol traffic." *J Clin Invest* 72(3): 743-7.

Brown and Goldstein (1992). "Koch's postulates for cholesterol." *Cell* 71(2): 187-8.

Brown, et al. (1981). "Regulation of plasma cholesterol by lipoprotein receptors." *Science* 212(4495): 628-35.

Chappell (1989). "High receptor binding affinity of lipoproteins in atypical dysbetalipoproteinemia (type III hyperlipoproteinemia)." *J Clin Invest* 84(6): 1906-15.

Cladaras, et al. (1987). "The molecular basis of a familial apoE deficiency. An acceptor splice site mutation in the third intron of the deficient apoE gene." *J Biol Chem* 262(5): 2310-5.

Corbo and Scacchi (1999). "Apolipoprotein E (APOE) allele distribution in the world. Is APOE'4 a 'thrifty' allele?" *Ann Hum Genet* 63(Pt 4): 301-10.

Corder, et al. (1993). "Gene dose of apolipoprotein E type 4 allele and the risk of Alzheimer's disease in late onset families." *Science* 261(5123): 921-3.

Corder, et al. (1994). "Protective effect of apolipoprotein E type 2 allele for late onset Alzheimer disease." *Nat Genet* 7(2): 180-4.

D'Arcangelo, et al. (1995). "A protein related to extracellular matrix proteins deleted in the mouse mutant reeler." *Nature* 374(6524): 719-23.

Das, et al. (1985). "Isolation, characterization, and mapping to chromosome 19 of the human apolipoprotein E gene." *J Biol Chem* 260(10): 6240-7.

Davis (1990). "The many faces of epidermal growth factor repeats." *New Biol* 2(5): 410-9.

de Knijff, et al. (1991). "Familial dysbetalipoproteinemia associated with apolipoprotein E3- Leiden in an extended multigeneration pedigree." *J Clin Invest* 88(2): 643-55.

Doolittle, et al. (1984). "Computer-based characterization of epidermal growth factor precursor." *Nature* 307(5951): 558-60.

Egensperger, et al. (1996). "The apolipoprotein E epsilon 4 allele in Parkinson's disease with Alzheimer lesions." *Biochem Biophys Res Commun* 224(2): 484-6.

Erickson (1993). "Tenascin-C, tenascin-R and tenascin-X: a family of talented proteins in search of functions." *Curr Opin Cell Biol* 5(5): 869-76.

Eto, et al. (1989). "Increased frequencies of apolipoprotein epsilon 2 and epsilon 4 alleles in patients with ischemic heart disease." *Clin Genet* 36(3): 183-8.

Farrer, et al. (1995). "Allele epsilon 4 of apolipoprotein E shows a dose effect on age at onset of Pick disease." *Exp Neurol* 136(2): 162-70.

Ferrais, et al. (1994). "Cloning, genomic organization, and osmotic response of the aldose reductase gene." *Proc Natl Acad Sci U S A* 91(22): 10742-6.

Feussner, et al. (1996). "Unusual xanthomas in a young patient with heterozygous familial hypercholesterolemia and type III hyperlipoproteinemia." *Am J Med Genet* 65(2): 149-54.

Fleming, et al. (1997). "Serrate-mediated activation of Notch is specifically blocked by the product of the gene fringe in the dorsal compartment of the Drosophila wing imaginal disc." *Development* 124(15): 2973-81.

Friedman, et al. (1999). "Apolipoprotein E-epsilon4 genotype predicts a poor outcome in survivors of traumatic brain injury." *Neurology* 52(2): 244-8.

Frisoni, et al. (1994). "Apolipoprotein E epsilon 4 allele frequency in vascular dementia and Alzheimer's disease." *Stroke* 25(8): 1703-4.

Garlepp, et al. (1995). "Apolipoprotein E epsilon 4 in inclusion body myositis." *Ann Neurol* 38(6): 957-9.

Gedde-Dahl, et al. (1984). "The locus for apolipoprotein E (apoE) is close to the Lutheran (Lu) blood groups locus on chromosome 19." *Hum Genet* 67(2): 178-82.

GenBank Accession No. A13997 (Feb. 22, 1994).
GenBank Accession No. A42845 (Mar. 6, 1997).
GenBank Accession No. A55548 (Mar. 17, 1999).
GenBank Accession No. AAA51747 (Oct. 31, 1994).
GenBank Accession No. AAK58523 (Jun. 2, 2001).
GenBank Accession No. AB015050 (Feb. 6, 1999).
GenBank Accession No. AB017139 (Apr. 6, 1999).
GenBank Accession No. AB025412 (May 8, 1999).
GenBank Accession No. AB040888 (Feb. 22, 2001).
GenBank Accession No. AF064748 (Jun. 18, 1998).
GenBank Accession No. AF263242 (Jun. 2, 2001).
GenBank Accession No. AK022708 (Sep. 29, 2000).
GenBank Accession No. AK024685 (Sep. 29, 2000).
GenBank Accession No. BAA36169 (Feb. 6, 1999).
GenBank Accession No. BAA84070 (Sep. 6, 1999).
GenBank Accession No. BAB14192 (Sep. 29, 2000).
GenBank Accession No. BAB72181 (Nov. 23, 2001).
GenBank Accession No. BC002862 (Jul. 12, 2001).
GenBank Accession No. CAA00205 (Mar. 5, 1993).
GenBank Accession No. CAA00975 (Nov. 26, 1993).
GenBank Accession No. CAA01607 (Mar. 2, 1995).
GenBank Accession No. CAA03490 (Mar. 5, 1998).
GenBank Accession No. CAC88580 (Sep. 28, 2001).
GenBank Accession No. CAC88658 (Sep. 28, 2001).
GenBank Accession No. I53872 (Sep. 4, 1998).
GenBank Accession No. M27875 (Mar. 6, 1995).
GenBank Accession No. M83670 (Apr. 27, 1993).
GenBank Accession No. M89902 (Apr. 27, 1993).
GenBank Accession No. O00744 (Jul. 15, 1999).
GenBank Accession No. O60664 (Aug. 20, 2001).
GenBank Accession No. P00740 (Oct. 16, 2001).
GenBank Accession No. P02647 (Oct. 16, 2001).
GenBank Accession No. P07098 (Oct. 16, 2001).
GenBank Accession No. P15568 (May 30, 2000).
GenBank Accession No. P22748 (Oct. 16, 2001).
GenBank Accession No. P29147 (Mar. 1, 2002).
GanBank Accession No. P38571 (Jul. 15, 1999).
GenBank Accession No. P48283 (Oct. 16, 2001).
GenBank Accession No. P48284 (Oct. 16, 2001).
GenBank Accession No. P48614 (May 30, 2000).
GenBank Accession No. P49085 (Mar. 1, 2002).
GenBank Accession No. P51178 (Oct. 16, 2001).
GenBank Accession No. P52895 (Feb. 15, 2000).
GenBank Accession No. P70701 (Oct. 16, 2001).
GenBank Accession No. Q02338 (Mar. 1, 2002).
GenBank Accession No. Q04828 (Mar. 1, 2002).
GenBank Accession No. Q13449 (Oct. 16, 2001).
GenBank Accession No. Q64444 (Oct. 16, 2001).
GenBank Accession No. Q95323 (Oct. 16, 2001).
GenBank Accession No. Q98919 (Oct. 16, 2001).
GenBank Accession No. S41408 (Jun. 18, 1999).
GenBank Accession No. U05598 (Aug. 20, 1994).
GenBank Accession No. U68535 (Nov. 27, 2001).
GenBank Accession No. U81787 (Jul. 5, 2001).
GenBank Accession No. X07496 (Apr. 26, 1993).
GenBank Accession No. X73889 (Mar. 10, 2001).

Gerdes, et al. (1996). "The apolipoprotein E polymorphism in Greenland Inuit in its global perspective." *Hum Genet* 98(5): 546-50.

Gerdes, et al. (1992). "The apolipoprotein E polymorphism in a Danish population compared to findings in 45 other study populations around the world." *Genet Epidemiol* 9(3): 155-67.

Ghiselli, et al. (1981). "Type III hyperlipoproteinemia associated with apolipoprotein E deficiency." *Science* 214(4526): 1239-41.
Greenberg, et al. (1995). "Apolipoprotein E epsilon 4 and cerebral hemorrhage associated with amyloid angiopathy." *Ann Neurol* 38(2): 254-9.
Greenberg, et al. (1998). "Association of apolipoprotein E epsilon2 and vasculopathy in cerebral amyloid angiopathy." *Neurology* 50(4): 961-5.
Gregg, et al. (1981). "Type III hyperlipoproteinemia: defective metabolism of an abnormal apolipoprotein E." *Science* 211(4482): 584-6.
Gregg, et al. (1983). "Apolipoprotein E alleles in severe hypertriglyceridaemia." *Lancet* 1(8320): 353.
Growdon, et al. (1996). "Apolipoprotein E genotype does not influence rates of cognitive decline in Alzheimer's disease." *Neurology* 47(2): 444-8.
Grundemann, et al. (1994). "Drug excretion mediated by a new prototype of polyspecific transporter." *Nature* 372(6506): 549-52.
Harrington, et al. (1995). "Apolipoprotein E type epsilon 4 allele frequency is increased in patients with schizophrenia." *Neurosci Lett* 202(1-2): 101-4.
Hazzard, et al. (1981). "Genetic transmission of isoapolipoprotein E phenotypes in a large kindred: relationship to dysbetalipoproteinemia and hyperlipidemia." *Metabolism* 30(1): 79-88.
Holtzman, et al. (1999). "Expression of human apolipoprotein E reduc s amyloid-beta deposition in a mouse model of Alzheimer's disease." *J Clin Invest* 103(6): R15-R21.
Holtzman, et al. (2000). "Apolipoprotein E isoform-dependent amyloid deposition and neuritic degeneration in a mouse model of Alzheimer's disease." *Proc Natl Acad Sci U S A* 97(6): 2892-7.
Houlden, et al. (1998). "ApoE genotype is a risk factor in nonpresenilin early-onset Alzheimer's disease families." *Am J Med Genet* 81(1): 117-21.
Houlston, et al. (1989). "Apolipoprotein (apo) E genotypes by polymerase chain reaction and allele-specific oligonucleotide probes: no detectable linkage disequilibrium between apo E and CII." *Hum Genet* 83(4): 364-8.
Humphries, et al. (1984). "The gene for apolipoprotein C-II is closely linked to the gene for apolipoprotein E on chromosome 19." *Clin Genet* 26(5): 389-96.
Hyman, et al. (1996). "Apolipoprotein E epsilon4/4 in a neuropathologically normal very elderly individual." *Arch Neurol* 53(3): 215.
Hyman, et al. (1995). "Quantitative analysis of senile plaques in Alzheimer disease: observation of log-normal size distribution and molecular epidemiology of differences associated with apolipoprotein E genotype and trisomy 21 (Down syndrome)." *Proc Natl Acad Sci U S A* 92(8): 3586-90.
Jagadeeswaran, et al. (1984). "Isolation and characterization of human factor IX cDNA: identification of Taq I polymorphism and regional assignment." *Somat Cell Mol Genet* 10(5): 465-73.
Jez, et al. (1997). "Comparative anatomy of the aldo-keto reductase superfamily." *Biochem J* 326(Pt 3): 625-36.
Joutel, et al. (1997). "Strong clustering and stereotyped nature of Notch3 mutations in CADASIL patients." *Lancet* 350(9090): 1511-5.
Kamboh, et al. (1995). "APOE*4-associated Alzheimer's disease risk is modified by alpha 1-antichymotrypsin polymorphism." *Nat Genet* 10(4): 486-8.
Kashyap, et al. (1995). "Apolipoprotein E deficiency in mice: gene replacement and prevention of atherosclerosis using adenovirus vectors." *J Clin Invest* 96(3): 1612-20.
Kawamata, et al. (1994). "Apolipoprotein E polymorphism in Japanese patients with Alzheimer's disease or vascular dementia." *J Neurol Neurosurg Psychiatry* 57(11): 1414-6.
Kehoe, et al. (1999). "Age of onset in Huntington disease: sex specific influence of apolipoprotein E genotype and normal CAG repeat length." *J Med Genet* 36(2): 108-11.
Kekuda, et al. (1998). "Cloning and functional characterization of a potential-sensitive, polyspecific organic cation transporter (OCT3) most abundantly expressed in placenta." *J Biol Chem* 273(26): 15971-9.

Kurosaka, et al. (1991). "Apolipoprotein E deficiency with a depressed mRNA of normal size." *Atherosclerosis* 88(1): 15-20.
Kurz, et al. (1996). "Apolipoprotein E epsilon 4 allele, cognitive decline, and deterioration of everyday performance in Alzheimer's disease." *Neurology* 47(2): 440-3.
Kushwaha, et al. (1977). "Type III hyperlipoproteinemia: paradoxical hypolipidemic response to estrogen." *Ann Intern Med* 87(5): 517-25.
Lambert, et al. (2000). "Independent association of an APOE gene promoter polymorphism with increased risk of myocardial infarction and decreased APOE plasma concentrations-the ECTIM study." *Hum Mol Genet* 9(1): 57-61.
Lannfelt, et al. (1995). "Apolipoprotein epsilon 4 allele in Swedish twins and siblings with Alzheimer disease." *Alzheimer Dis Assoc Disord* 9(3): 166-9.
Levine, et al. (1994). "Odd Oz: a novel Drosophila pair rule gene." *Cell* 77(4): 587-98.
Levine, et al. (1997). "Expression of the pair-rule gene odd Oz (odz) in imaginal tissues." *D v Dyn* 209(1): 1-14.
L vy and Morganroth (1977). "Familial type III hyperlipoproteinemia." *Ann Intern Med* 87(5): 625-8.
Levy-Lahad, et al. (1995). "Apolipoprotein E genotypes and age of onset in early-onset familial Alzheimer's disease." *Ann Neurol* 38(4): 678-80.
Linton, et al. (1995). "Prevention of atherosclerosis in apolipoprotein E-deficient mice by bone marrow transplantation." *Science* 267(5200): 1034-7.
Lippa, et al. (1995). "Apolipoprotein E genotype and Lewy body disease." *Neurology* 45(1): 97-103.
Lucotte, et al. (1994). "Apolipoprotein E-epsilon 4 allele doses in late-onset Alzheimer's disease." *Ann Neurol* 36(4): 681-2.
Lusis, et al. (1986). "Regional mapping of human chromosome 19: organization of genes for plasma lipid transport (APOC1, -C2, and -E and LDLR) and the genes C3, PEPD, and GPI." *Proc Natl Acad Sci U S A* 83(11): 3929-33.
Mabuchi, et al. (1989). "A young type III hyperlipoproteinemic patient associated with apolipoprotein E deficiency." *Metabolism* 38(2): 115-9.
Mahley (1988). "Apolipoprotein E: cholesterol transport protein with expanding role in cell biology." *Science* 240(4852): 622-30.
Marder, et al. (1994). "The apolipoprotein epsilon 4 allele in Parkinson's disease with and without dementia." *Neurology* 44(7): 1330-1.
Marks, et al. (1992). "Molecular cloning and characterization of (R)-3-hydroxybutyrate dehydrogenase from human heart." *J Biol Chem* 267(22): 15459-63.
Masliah, et al. (1995). "Neurodegeneration in the central nervous system of apoE-deficient mice." *Exp Neurol* 136(2): 107-22.
McCarron, et al. (1999). "APOE genotype as a risk factor for ischemic cerebrovascular disease: a meta-analysis." *Neurology* 53(6): 1308-11.
Meyer, et al. (1998). "APOE genotype predicts when—not whether—one is predisposed to develop Alzheimer disease." *Nat Genet* 19(4): 321-2.
Mui, et al. (1995). "Apolipoprotein E epsilon 4 allele is not associated with earlier age at onset in amyotrophic lateral sclerosis." *Ann Neurol* 38(3): 460-3.
Myers, et al. (1996). "Apolipoprotein E epsilon4 association with dementia in a population- based study: The Framingham study." *Neurology* 46(3): 673-7.
Nakayama, et al. (1998). "Identification of high-molecular-weight proteins with multiple EGF-like motifs by motif-trap screening." *Genomics* 51(1): 27-34.
Nalbantoglu, et al. (1994). "Predictive value of apolipoprotein E genotyping in Alzheimer's disease: results of an autopsy series and an analysis of several combined studies." *Ann Neurol* 36(6): 889-95.
Nicoll, et al. (1995). "Apolipoprotein E epsilon 4 allele is associated with deposition of amyloid beta- protein following head injury." *Nat Med* 1(2): 135-7.
Nusslein-Volhard and Wleschaus (1980). "Mutations affecting segment number and polarity in Drosophila." *Nature* 287(5785): 795-801.

O'Donnell, et al. (2000). "Apolipoprotein E genotype and the risk of recurrent lobar intracerebral hemorrhage." *N Engl J Med 342*(4): 240-5.
Okuda, et al. (1996). "cDNA cloning and functional expression of a novel rat kidney organic cation transporter, Oct. 2." *Biochem Biophys Res Commun 224*(2): 500-7.
Olaisen, et al. (1982). "The locus for apolipoprotein E (apoE) is linked to the complement component C3 (C3) locus on chromosome 19 in man." *Hum Genet 62*(3): 233-6.
Olichney, et al. (1996). "The apolipoprotein E epsilon 4 allele is associated with increased neuritic plaques and cerebral amyloid angiopathy in Alzheimer's disease and Lewy body variant." *Neurology 47*(1): 190-6.
O'Malley and Illingworth (1992). "Apolipoprotein epsilon 4 and coronary artery disease." *Lancet 340*(8831): 1350-1.
OMIM Accession No. 164820 (Jun. 2, 1986).
OMIM Accession No. 600512 (May 3, 1995).
OMIM Accession No. 603399 (Jan. 5, 1999).
OMIM Accession No. 603490 (Feb. 4, 1999).
OMIM Accession No. 604031 (Jul. 20, 1999).
Oohashi, et al. (1999). "Mouse ten-m/Odz is a new family of dimeric type II transmembrane proteins expressed in many tissues." *J Cell Biol 145*(3): 563-77.
Osuntokun, et al. (1995). "Lack of an association between apolipoprotein E epsilon 4 and Alzheimer's disease in elderly Nigerians." *Ann Neurol 38*(3): 463-5.
Payami, et al. (1997). "A prospective study of cognitive health in the elderly (Oregon Brain Aging Study): effects of family history and apolipoprotein E genotype." *Am J Hum Genet 60*(4): 948-56.
Payami, et al. (1996). "Gender difference in apolipoprotein E-associated risk for familial Alzhemier disease: a possible clue to the higher incidence of Alzheimer disease in women." *Am J Hum Genet 58*(4): 803-11.
Payne, et al. (1992). "Apolipoprotein epsilon 4 and coronary artery disease." *Lancet 340*(8831): 1350.
Piedrahita, et al. (1992). "Generation of mice carrying a mutant apolipoprotein E gene inactivated by gene targeting in embryonic stem cells." *Proc Natl Acad Sci U S A 89*(10): 4471-5.
Plump, et al. (1992). "Severe hypercholesterolemia and atherosclerosis in apolipoprotein E- deficient mice created by homologous recombination in ES cells." *Cell 71*(2): 343-53.
Poirier (1994). "Apolipoprotein E in animal models of CNS injury and in Alzheimer's disease." *Trends Neurosci 17*(12): 525-30.
Poirier, et al. (1993). "Apolipoprotein E polymorphism and Alzheimer's disease." *Lancet 342*(8873): 697-9.
Poirer, et al. (1995). "Apolipoprotein E4 allele as a predictor of cholinergic deficits and treatment outcome in Alzheimer disease." *Proc Natl Acad Sci U S A 92*(26): 12260-4.
Polvikoski, et al. (1995). "Apolipoprotein E, dementia, and cortical deposition of beta-amyloid protein." *N Engl J Med 333*(19): 1242-7.
Raber, et al. (2000). "Apolipoprotein E and cognitive peformance." *Nature 404*(6776): 352-4.
Rall, et al. (1982). "Human apolipoprotein E. The complete amino acid sequence." *J Biol Chem 257*(8): 4171-8.
Rall, et al. (1982). "Structural basis for receptor binding heterogeneity of apolipoprotein E from type III hyperlipoproteinemic subjects." *Proc Natl Acad Sci U S A 79*(15): 4696-700.
Rall, et al. (1983). "Identification of a new structural variant of human apolipoprotein E, E2(Lys146 leads to Gln), in a type III hyperlipoproteinemic subject with the E3/2 phenotype." *J Clin Invest 72*(4): 1288-97.
Reiman, et al. (1996). "Preclinical evidence of Alzheimer's disease in persons homozygous for the epsilon 4 allele for apolipoprotein E." *N Engl J Med 334*(12): 752-8.
Royston, et al. (1994). "Apolipoprotein E epsilon 2 allele promotes longevity and protects patients with Down's syndrome from dementia." *Neuroreport 5*(18): 2583-5.
Sanan, et al. (1994). "Apolipoprotein E associates with beta amyloid peptide of Alzheimer's disease to form novel monofibrils. Isoform apoE4 associates more efficiently than apoE3." *J Clin Invest 94*(2): 860-9.

Saunders, et al. (1993). "Apolipoprotein E epsilon 4 allele distributions in late-onset Alzheimer's disease and in other amyloid-forming diseases." *Lancet 342*(8873): 710-1.
Saunders, et al. (1993). "Association of apolipoprotein E allele epsilon 4 with late-onset familial and sporadic Alzheimer's diseas ." *Neurology 43*(8): 1467-72.
Schachter, et al. (1994). "Genetic associations with human longevity at the APOE and ACE loci." *Nat Genet 6*(1): 29-32.
Schaefer, et al. (1986). "Familial apolipoprotein E deficiency." *J Clin Invest 78*(5): 1206-19.
Scherer, et al. (1998). "Cloning of cell-specific secreted and surface proteins by subtractive antibody screening." *Nat Biotechnol 16*(6): 581-6.
Schneider, et al. (1981). "Familial dysbetalipoproteinemia. Abnormal binding of mutant apoprotein E to low density lipoprotein receptors of human fibroblasts and membranes from liver and adrenal of rats, rabbits, and cows." *J Clin Invest 68*(4): 1075-85.
Slooter, et al. (1996). "APOE genotyping in differential diagnosis of Alzheimer's disease." *Lancet 348*(9023): 334.
Smit, et al. (1987). "Familial dysbetalipoproteinemic subjects with the E3/E2 phenotype exhibit an E2 isoform with only one cysteine residue." *Clin Genet 32*(5): 335-41.
Smit, et al. (1990). "Genetic heterogeneity in familial dysbetalipoproteinemia. The E2(lys 146—gln) variant results in a dominant mode of inheritance." *J Lipid Res 31*(1): 45-53.
Spring, et al. (1989). "Two contrary functions of tenascin: dissection of the active sites by recombinant tenascin fragments." *Cell 59*(2): 325-34.
St Clair, et al. (1995). "Apolipoprotein E epsilon 4 allele is a risk factor for familial and sporadic presenile Alzheimer's disease in both homozygote and heterozygote carriers." *J Med Genet 32*(8): 642-4.
St Jonhston and Nusslein-Volhard (1992). "The origin of pattern and polarity in the Drosophila embryo." *Cell 68*(2): 201-19.
Strittmatter, et al. (1993). "Apolipoprotein E: high-avidity binding to beta-amyloid and increased frequency of type 4 allele in late-onset familial Alzheimer disease." *Proc Natl Acad Sci U S A 90*(5): 1977-81.
Sullivan, et al. (1997). "Targeted replacement of the mouse apolipoprotein E gene with the common human APOE3 allele enhances diet-induced hypercholesterolemia and atherosclerosis." *J Biol Chem 272*(29): 17972-80.
SWALL (SPTR) Accession No. O07854 (Jul. 1, 1997).
SWALL (SPTR) Accession No. O09125 (Jul. 1, 1997).
SWALL (SPTR) Accession No. O14546 (Jan. 1, 1998).
SWALL (SPTR) Accession No. O14567 (Jan. 1, 1998).
SWALL (SPTR) Accession No. O88278 (Nov. 1, 1998).
SWALL (SPTR) Accession No. O88492 (Nov. 1, 1998).
SWALL (SPTR) Accession No. P79753 (May 1, 1997).
SWALL (SPTR) Accession No. Q14316 (Nov. 1, 1996).
SWALL (SPTR) Accession No. Q16529 (Oct. 1, 1994).
SWALL (SPTR) Accession No. Q60450 (Nov. 1, 1996).
SWALL (SPTR) Accession No. Q62192 (Jun. 1, 1998).
SWALL (SPTR) Accession No. Q91Z10 (Dec. 1, 2001).
SWALL (SPTR) Accession No. Q92038 (Jan. 1, 1999).
SWALL (SPTR) Accession No. Q923L4 (Dec. 1, 2001).
SWALL (SPTR) Accession No. Q95JH6 (Dec. 1, 2001).
SWALL (SPTR) Accession No. Q95ND7 (Dec. 1, 2001).
SWALL (SPTR) Accession No. Q96A71 (Dec. 1, 2001).
SWALL (SPTR) Accession No. Q96EJ0 (Oct. 1, 1994).
SWALL (SPTR) Accession No. Q96ET1 (Dec. 1, 2001).
SWALL (SPTR) Accession No. Q96FL6 (Dec. 1, 2001).
SWALL (SPTR) Accession No. Q96J84 (Dec. 1, 2001).
SWALL (SPTR) Accession No. Q96JD6 (Dec. 1, 2001).
SWALL (SPTR) Accession No. Q96JG0 (Dec. 1, 2001).
SWALL (SPTR) Accession No. Q96M90 (Dec. 1, 2001).
SWALL (SPTR) Accession No. Q96Q06 (Dec. 1, 2001).
SWALL (SPTR) Accession No. Q96RU0 (Dec. 1, 2001).
SWALL (SPTR) Accession No. Q96WU8 (Dec. 1, 2001).
SWALL (SPTR) Accession No. Q98MG7 (Oct. 1, 2001).
SWALL (SPTR) Accession No. Q98MG8 (Oct. 1, 2001).
SWALL (SPTR) Accession No. Q99467 (Jun. 1, 1998).
SWALL (SPTR) Accession No. Q99R75 (Jun. 1, 2001).

SWALL (SPTR) Accession No. Q9BRZ4 (Jun. 1, 2001).
SWALL (SPTR) Accession No. Q9BS03 (Jun. 1, 2001).
SWALL (SPTR) Accession No. Q9BU71 (Jun. 1, 2001).
SWALL (SPTR) Accession No. Q9D5Z0 (Jun. 1, 2001).
SWALL (SPTR) Accession No. Q9D8L2 (Jun. 1, 2001).
SWALL (SPTR) Accession No. Q9DBG5 (Jun. 1, 2001).
SWALL (SPTR) Accession No. Q9DCT1 (Jun. 1, 2001).
SWALL (SPTR) Accession No. Q9DER5 (Mar. 1, 2001).
SWALL (SPTR) Accession No. Q9H9N1 (Mar. 1, 2001).
SWALL (SPTR) Accession No. Q9HCU4 (Mar. 1, 2001).
SWALL (SPTR) Accession No. Q9JLC1 (Oct. 1, 2000).
SWALL (SPTR) Accession No. Q9M608 (Oct. 1, 2000).
SWALL (SPTR) Accession No. Q9NVA5 (Oct. 1, 2000).
SWALL (SPTR) Accession No. Q9NYQ7 (Oct. 1, 2000).
SWALL (SPTR) Accession No. Q9P273 (Oct. 1, 2000).
SWALL (SPTR) Accession No. Q9PU86 (May. 1, 2000).
SWALL (SPTR) Accession No. Q9PW15 (May 1, 2000).
SWALL (SPTR) Accession No. Q9R0M0 (May 1, 2000).
SWALL (SPTR) Accession No. Q9R1K2 (May 1, 2000).
SWALL (SPTR) Accession No. Q9UJ10 (May 1, 2000).
SWALL (SPTR) Accession No. Q9W6V1 (Nov. 1, 1999).
SWALL (SPTR) Accession No. Q9W6V2 (Nov. 1, 1999).
SWALL (SPTR) Accession No. Q9W7R4 (Nov. 1, 1999).
SWALL (SPTR) Accession No. Q9WTS6 (Nov. 1, 1999).
SWALL (SPTR) Accession No. Q9WTS7 (Nov. 1, 1999).
SWALL (SPTR) Accession No. Q9YGM2 (May 1, 1999).
SWALL (SPTR) Accession No. Q9Z0J8 (May 30, 2000).
SWALL (SPTR) Accession No. Q9Z1B4 (May 1, 1999).
Tabaton, et al. (1995). "Apolipoprotein E epsilon 4 allele frequency is not increased in progressive supranuclear palsy." *Neurology* 45(9): 1764-5.
Talbot, et al. (1994). "Protection against Alzheimer's disease with apoE epsilon 2." *Lancet* 343(8910): 1432-3.
Tamai, et al. (1997). "Cloning and characterization of a novel human pH-dependent organic cation transporter, OCTN1." *FEBS Lett* 419(1): 107-11.
Tang, et al. (1996). "Relative risk of Alzheimer disease and age-at-onset distributions, based on APOE genotypes among elderly African Americans, Caucasians, and Hispanics in New York City." *Am J Hum Genet* 58(3): 574-84.
Tomimoto, et al. (1995). "Immunohistochemical study of apolipoprotein E in human cerebrovascular white matter lesions." *Acta Neuropathol* 90(6): 608-14.
Usui, et al. (1999). "Flamingo, a seven-pass transmembrane cadherin, regulates planar cell polarity under the control of Frizzled." *Cell* 98(5): 585-95.
Utermann, et al. (1979). "Polymorphism of apolipoprotein E. III. Effect of a single polymorphic gene locus on plasma lipid levels in man." *Clin Genet* 15(1): 63-72.
Utermann, et al. (1980). "Genetics of the apolipoprotein E system in man." *Am J Hum Genet* 32(3): 339-47.
van Bockxmeer and Mamotte (1992). "Apolipoprotein epsilon 4 homozygosity in young men with coronary heart disease." *Lancet* 340(8824): 879-80.
van Gool, et al. (1995). "A case-control study of apolipoprotein E genotypes in Alzheimer's disease associated with Down's syndrome. Dutch Study Group on Down's Syndrome and Ageing." *Ann Neurol* 38(2): 225-30.
van Ree, et al. (1995). "Inactivation of APOE and Apoc 1 by two consecutive rounds of gene targeting: effects on mRNA expression levels of gene cluster members." *Hum Mol Genet* 4(8): 1403-9.
Vogel, et al. (1985). "Human apolipoprotein E expression in *Escherichia coli*: structural and functional identity of the bacterially produced protein with plasma apolipoprotein E." *Proc Natl Acad Sci U S A* 82(24): 8696-700.
Wang, et al. (1998). "Identification of novel stress-induced genes downstream of chop." *Embo J* 17(13): 3619-30.
Wang, et al. (2000). "Functional analysis of mutations in the OCTN2 transporter causing primary carnitine deficiency: lack of genotype-phenotype correlation." *Hum Mutat* 16(5): 401-7.

Wardell, et al. (1989). "Apolipoprotein E3-Leiden contains a seven-amino acid insertion that is a tandem repeat of residues 121-127." *J Biol Chem* 264(35): 21205-10.
Weisgraber, et al. (1981). "Human E apoprotein heterogeneity. Cysteine-arginine interchanges in the amino acid sequence of the apo-E isoforms." *J Biol Chem* 256(17): 9077-83.
Weisgraber, et al. (1982). "Abnormal lipoprotein receptor-binding activity of the human E apoprotein due to cysteine-arginine interchange at a single site." *J Biol Chem* 257(5): 2518-21.
Whelan (1996). "Selectin synthesis and inflammation." *Trends Biochem Sci* 21(2): 65-9.
Wiebusch, et al. (1999). "Further evidence for a synergistic association between APOE epsilon4 and BCHE-K in confirmed Alzheimer's disease." *Hum Genet* 104(2): 158-63.
Wootton and Federhen (1996). "Analysis of compositionally biased regions in sequence databases." *Methods Enzymol* 266: 554-71.
Wu, et al. (1998). "cDNA sequence, transport function, and genomic organization of human OCTN2, a new member of the organic cation transporter family." *Biochem Biophys Res Commun* 246(3): 589-95.
Yoshizawa, et al. (1994). "Dose-dependent association of apolipoprot in E allele epsilon 4 with lat—onset, sporadic Alzheimer's disease." *Ann Neurol* 36(4): 656-9.
Zannis, et al. (1981). "Human apolipoprotein E isoprotein subclasses are g netically determined." *Am J Hum Genet* 33(1): 11-24.
Zhang, et al. (1997). "Cloning and functional expression of a human liver organic cation transporter." *Mol Pharmacol* 51(6): 913-21.
Zhang, et al. (1992). "Spontaneous hypercholesterolemia and arterial lesions in mice lacking apolipoprotein E." *Science* 258(5081): 468-71.
Zinszner, et al. (1998). "CHOP is implicated in programmed cell death in response to impaired function of the endoplasmic reticulum." *Genes Dev* 12(7): 982-95.
SWALL (SPTR) Accession No. Q9JLC1 (Oct. 1, 2000).
SWALL (SPTR) Accession No. Q9NV77 (Oct. 1, 2000).
SWALL (SPTR) Accession No. Q9NVW1 (Oct. 1, 2000).
SWALL (SPTR) Accession No. Q9NZJ2 (Oct. 1, 2000).
SWALL (SPTR) Accession No. Q9P273 (Oct. 1, 2000).
SWALL (SPTR) Accession No. Q9WTS6 (Nov. 1, 1999).
Anderson, R. A., R. S. Byrum, et al. (1994). "Mutations at the lysosomal acid cholesteryl ester hydrolase gene locus in Wolman disease." *Proc Natl Acad Sci U S A* 91(7): 2718-22.
Ben-Zur, T., E. Feige, et al. (2000). "The mammalian Odz gene family: homologs of a Drosophila pair-rule gene with expression implying distinct yet overlapping developmental roles." *Dev Biol* 217(1): 107-20.
Nagase, T., R. Kikuno, et al. (2000). "Prediction of the coding sequences of unidentified human genes. XVII. The complete sequences of 100 new cDNA clones from brain which code for large proteins in vitro." *DNA Res* 7(2): 143-50.
Anderson, et al., "Mutations at the Lysosomal Acid Cholesteryl Ester Hydrolase Gene Locus in Wolman Disease", *Proc. Natl. Acad. Sci. USA*, 91:2718-2722 (1994).
Attwood, "The Babel of Bioinformatics", *Science*, 290:471-473 (2000).
Database NCBI on STN, AN P38571, GENBANK, Oct. 1, 1994, Anderson et al., *Biol. Chem.*, 266:22479-22484 (1991).
Gerhold, et al., "It's the Genes! EST Access to Human Genome Content", *BioEssays*, 18:973-981 (1996).
Lopez, et al., "Whole-Genome Sequence Annotation: 'Going Wrong with Confidence'", *Molecular Microbiology*, 32:886-887 (1999).
Russell, et al., "Structural Features Can Be Unconserved in Proteins with Similar Folds", *J. Mol. Biol.*, 244:332-350 (1994).
Wells, et al., "The Chemokine Information Source: Identification and Characterization of Novel Chemokines Using the WorldWideWeb and Expressed Sequence Tag Database", *Journal of Leukocyte Biology*, 61:545-550 (1997).

\* cited by examiner

PROTEINS AND NUCLEIC ACIDS ENCODING SAME

RELATED APPLICATIONS

This application claims priority from Provisional Applications U.S. Ser. No. 60/258,928, filed Dec. 29, 2000, U.S. Ser. No. 60/259,415, filed Jan. 2, 2001, U.S. Ser. No. 60/259,785, filed Jan. 4, 2001, U.S. Ser. No. 60/269,814, filed Feb. 20, 2001, U.S. Ser. No. 60/279,832, filed Mar. 29, 2001, U.S. Ser. No. 60/279,833, filed Mar. 29, 2001, U.S. Ser. No. 60/279,863, filed Mar. 29, 2001, U.S. Ser. No. 60/283,889, filed Apr. 13, 2001, U.S. Ser. No. 60/284,447, filed Apr. 18, 2001, U.S. Ser. No. 60/286,683, filed Apr. 25, 2001, U.S. Ser. No. 60/294,080, filed May 29, 2001, U.S. Ser. No. 60/312,915, filed Aug. 16, 2001, U.S. Ser. No. 60/313,325, filed Aug. 17, 2001, U.S. Ser. No. 60/322,699, filed Sep. 17, 2001, U.S.S.N. not yet assigned, filed Nov. 26, 2001, each of which is incorporated by reference in its entirety.

FIELD OF THE INVENTION

The invention relates to polynucleotides and the polypeptides encoded by such polynucleotides, as well as vectors, host cells, antibodies and recombinant methods for producing the polypeptides and polynucleotides, as well as methods for using the same.

BACKGROUND OF THE INVENTION

The invention generally relates to nucleic acids and polypeptides encoded therefrom. More specifically, the invention relates to nucleic acids encoding cytoplasmic, nuclear, membrane bound, and secreted polypeptides, as well as vectors, host cells, antibodies, and recombinant methods for producing these nucleic acids and polypeptides.

SUMMARY OF THE INVENTION

The invention is based in part upon the discovery of nucleic acid sequences encoding novel polypeptides. The novel nucleic acids and polypeptides are referred to herein as NOVX, or NOV1, NOV2, NOV3, NOV4, NOV5, NOV6, NOV7, NOV8, NOV9, NOV10, NOV11, NOV12, NOV13, NOV14, NOV15, NOV16, NOV17, NOV18, NOV19, and NOV20 nucleic acids and polypeptides. These nucleic acids and polypeptides, as well as variants, derivatives, homologs, analogs and fragments thereof, will hereinafter be collectively designated as "NOVX" nucleic acid or polypeptide sequences.

In one aspect, the invention provides an isolated NOVX nucleic acid molecule encoding a NOVX polypeptide that includes a nucleic acid sequence that has identity to the nucleic acids disclosed in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, and 59. In some embodiments, the NOVX nucleic acid molecule will hybridize under stringent conditions to a nucleic acid sequence complementary to a nucleic acid molecule that includes a protein-coding sequence of a NOVX nucleic acid sequence. The invention also includes an isolated nucleic acid that encodes a NOVX polypeptide, or a fragment, homolog, analog or derivative thereof. For example, the nucleic acid can encode a polypeptide at least 80% identical to a polypeptide comprising the amino acid sequences of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, and 60. The nucleic acid can be, for example, a genomic DNA fragment or a cDNA molecule that includes the nucleic acid sequence of any of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59.

Also included in the invention is an oligonucleotide, e.g., an oligonucleotide which includes at least 6 contiguous nucleotides of a NOVX nucleic acid (e.g., SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59) or a complement of said oligonucleotide.

Also included in the invention are substantially purified NOVX polypeptides (SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, and 60). In certain embodiments, the NOVX polypeptides include an amino acid sequence that is substantially identical to the amino acid sequence of a human NOVX polypeptide.

The invention also features antibodies that immunoselectively bind to NOVX polypeptides, or fragments, homologs, analogs or derivatives thereof.

In another aspect, the invention includes pharmaceutical compositions that include therapeutically- or prophylactically-effective amounts of a therapeutic and a pharmaceutically-acceptable carrier. The therapeutic can be, e.g., a NOVX nucleic acid, a NOVX polypeptide, or an antibody specific for a NOVX polypeptide. In a further aspect, the invention includes, in one or more containers, a therapeutically- or prophylactically-effective amount of this pharmaceutical composition.

In a further aspect, the invention includes a method of producing a polypeptide by culturing a cell that includes a NOVX nucleic acid, under conditions allowing for expression of the NOVX polypeptide encoded by the DNA. If desired, the NOVX polypeptide can then be recovered.

In another aspect, the invention includes a method of detecting the presence of a NOVX polypeptide in a sample. In the method, a sample is contacted with a compound that selectively binds to the polypeptide under conditions allowing for formation of a complex between the polypeptide and the compound. The complex is detected, if present, thereby identifying the NOVX polypeptide within the sample.

The invention also includes methods to identify specific cell or tissue types based on their expression of a NOVX.

Also included in the invention is a method of detecting the presence of a NOVX nucleic acid molecule in a sample by contacting the sample with a NOVX nucleic acid probe or primer, and detecting whether the nucleic acid probe or primer bound to a NOVX nucleic acid molecule in the sample.

In a further aspect, the invention provides a method for modulating the activity of a NOVX polypeptide by contacting a cell sample that includes the NOVX polypeptide with a compound that binds to the NOVX polypeptide in an amount sufficient to modulate the activity of said polypeptide. The compound can be, e.g., a small molecule, such as a nucleic acid, peptide, polypeptide, peptidomimetic, carbohydrate, lipid or other organic (carbon containing) or inorganic molecule, as further described herein.

Also within the scope of the invention is the use of a therapeutic in the manufacture of a medicament for treating or preventing disorders or syndromes including, e.g., those described for the individual NOVX nucleotides and polypeptides herein, and/or other pathologies and disorders of the like.

The therapeutic can be, e.g., a NOVX nucleic acid, a NOVX polypeptide, or a NOVX-specific antibody, or biologically-active derivatives or fragments thereof. For example, the compositions of the present invention will have efficacy for treatment of patients suffering from the diseases and disorders disclosed below and/or other pathologies and disorders of the like. The polypeptides can be used as immunogens to produce antibodies specific for the invention, and as vaccines. They can also be used to screen for potential agonist and antagonist compounds. For example, a cDNA encoding NOVX may be useful in gene therapy, and NOVX may be useful when administered to a subject in need thereof. By way of non-limiting example, the compositions of the present invention will have efficacy for treatment of patients suffering from the diseases and disorders disclosed above and/or other pathologies and disorders of the like.

The invention further includes a method for screening for a modulator of disorders or syndromes including, e.g., the diseases and disorders disclosed above and/or other pathologies and disorders of the like. The method includes contacting a test compound with a NOVX polypeptide and determining if the test compound binds to said NOVX polypeptide. Binding of the test compound to the NOVX polypeptide indicates the test compound is a modulator of activity, or of latency or predisposition to the aforementioned disorders or syndromes.

Also within the scope of the invention is a method for screening for a modulator of activity, or of latency or predisposition to an disorders or syndromes including, e.g., the diseases and disorders disclosed above and/or other pathologies and disorders of the like by administering a test compound to a test animal at increased risk for the aforementioned disorders or syndromes. The test animal expresses a recombinant polypeptide encoded by a NOVX nucleic acid. Expression or activity of NOVX polypeptide is then measured in the test animal, as is expression or activity of the protein in a control animal which recombinantly-expresses NOVX polypeptide and is not at increased risk for the disorder or syndrome. Next, the expression of NOVX polypeptide in both the test animal and the control animal is compared. A change in the activity of NOVX polypeptide in the test animal relative to the control animal indicates the test compound is a modulator of latency of the disorder or syndrome.

In yet another aspect, the invention includes a method for determining the presence of or predisposition to a disease associated with altered levels of a NOVX polypeptide, a NOVX nucleic acid, or both, in a subject (e.g., a human subject). The method includes measuring the amount of the NOVX polypeptide in a test sample from the subject and comparing the amount of the polypeptide in the test sample to the amount of the NOVX polypeptide present in a control sample. An alteration in the level of the NOVX polypeptide in the test sample as compared to the control sample indicates the presence of or predisposition to a disease in the subject. Preferably, the predisposition includes, e.g., the diseases and disorders disclosed above and/or other pathologies and disorders of the like. Also, the expression levels of the new polypeptides of the invention can be used in a method to screen for various cancers as well as to determine the stage of cancers.

In a further aspect, the invention includes a method of treating or preventing a pathological condition associated with a disorder in a mammal by administering to the subject a NOVX polypeptide, a NOVX nucleic acid, or a NOVX-specific antibody to a subject (e.g., a human subject), in an amount sufficient to alleviate or prevent the pathological condition. In preferred embodiments, the disorder, includes, e.g., the diseases and disorders disclosed above and/or other pathologies and disorders of the like.

In yet another aspect, the invention can be used in a method to identity the cellular receptors and downstream effectors of the invention by any one of a number of techniques commonly employed in the art. These include but are not limited to the two-hybrid system, affinity purification, co-precipitation with antibodies or other specific-interacting molecules. Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and not intended to be limiting.

Other features and advantages of the invention will be apparent from the following detailed description and claims.

DETAILED DESCRIPTION OF THE INVENTION

The present invention provides novel nucleotides and polypeptides encoded thereby. Included in the invention are the novel nucleic acid sequences and their polypeptides. The sequences are collectively referred to as "NOVX nucleic acids" or "NOVX polynucleotides" and the corresponding encoded polypeptides are referred to as "NOVX polypeptides" or "NOVX proteins." Unless indicated otherwise, "NOVX" is meant to refer to any of the novel sequences disclosed herein. Table A provides a summary of the NOVX nucleic acids and their encoded polypeptides.

TABLE A

Sequences and Corresponding SEQ ID Numbers

| NOVX | Internal Identification | SEQ ID NO (nt) | SEQ ID NO (aa) | Homology |
|---|---|---|---|---|
| 1 | Sgqc_draft_ba186014_2 0000730_da1 | 1 | 2 | Lysosomal Acid Lipase Precursor |
| 2 | 20708613_EXT1 | 3 | 4 | MEGF/Flamingo/Cadherin |
| 3 | CG55806_01 | 5 | 6 | Coagulation Factor IX Precursor |
| 4 | CG55936_01 | 7 | 8 | Carbonic Anhydrase IV |
| 5 | CG55784_01 | 9 | 10 | Neural Cell Adhesion Molecule |

TABLE A-continued

Sequences and Corresponding SEQ ID Numbers

| NOVX | Internal Identification | SEQ ID NO (nt) | SEQ ID NO (aa) | Homology |
|---|---|---|---|---|
| 6 | CG55916_01 | 11 | 12 | Phospholipase C Delta |
| 7 | CG55802_01 | 13 | 14 | 3 Alpha Hydroxy Steroid Dehydrogenase |
| 8 | CG55904_01 | 15 | 16 | Squalene Desaturase |
| 9 | CG55954_01 | 17 | 18 | Lymphocyte Antigen 64 |
| 10 | CG55910_01 | 19 | 20 | Acyl-CoA Desaturase |
| 11 | CG50281_01 | 21 | 22 | Wnt 10B Protein Precursor |
| 12a | CG55920_01 | 23 | 24 | Kilon Protein Precursor |
| 12b | CG55920_04 | 25 | 26 | Kilon Protein Precursor |
| 13a | CG55988_01 | 27 | 28 | organic Cation Transporter |
| 13b | CG55988_02 | 29 | 30 | organic Cation Transporter |
| 14a | CG56001_01 | 31 | 32 | D-beta Hydroxy Hydroxybutyrate Dehydrogenase |
| 14b | CG56001_02 | 33 | 34 | D-beta Hydroxy Hydroxybutyrate Dehydrogenase |
| 15a | SC145665404_A/CG55069_01 | 35 | 36 | TEN-M3 |
| 15b | CG55069_02 | 37 | 38 | TEN-M3 |
| 15c | CG55069_03 | 39 | 40 | TEN-M3 |
| 15d | CG55069_08 | 41 | 42 | TEN-M3 |
| 16a | CG55778_01 | 43 | 44 | Aldose Reductase |
| 16b | CG55778_02 | 45 | 46 | Aldose Reductase |
| 16c | CG55778_03 | 47 | 48 | Aldose Reductase |
| 16d | CG55778_04 | 49 | 50 | Aldose Reductase |
| 16e | CG55778_05 | 51 | 52 | Aldose Reductase |
| 17 | CG55982_01 | 53 | 54 | Apolipoprotein A-1 |
| 18 | CG56747_02 | 55 | 56 | Apolipoprotein A-1 |
| 19 | CG55906_01 | 57 | 58 | S3_12 |
| 20 | CG55906_02 | 59 | 60 | S3_12 |

NOVX nucleic acids and their encoded polypeptides are useful in a variety of applications and contexts. The various NOVX nucleic acids and polypeptides according to the invention are useful as novel members of the protein families according to the presence of domains and sequence relatedness to previously described proteins. Additionally, NOVX nucleic acids and polypeptides can also be used to identify proteins that are members of the family to which the NOVX polypeptides belong.

The NOVX genes and their corresponding encoded proteins are useful for preventing, treating or ameliorating medical conditions, e.g., by protein or gene therapy. Pathological conditions can be diagnosed by determining the amount of the new protein in a sample or by determining the presence of mutations in the new genes. Specific uses are described for each of the sixteen genes, based on the tissues in which they are most highly expressed. Uses include developing products for the diagnosis or treatment of a variety of diseases and disorders.

The NOVX nucleic acids and polypeptides can also be used to screen for molecules, which inhibit or enhance NOVX activity or function. Specifically, the nucleic acids and polypeptides according to the invention may be used as targets for the identification of small molecules that modulate or inhibit, e.g., neurogenesis, cell differentiation, cell proliferation, hematopoiesis, wound healing and angiogenesis.

In one embodiment of the present invention, NOVX or a fragment or derivative thereof may be administered to a subject to treat or prevent a disorder associated with decreased expression or activity of NOVX. Examples of such disorders include, but are not limited to, cancers such as adenocarcinoma, leukemia, lymphoma, melanoma, myeloma, sarcoma, teratocarcinoma, and, in particular, cancers of the adrenal gland, bladder, bone, bone marrow, brain, breast, cervix, gall bladder, ganglia, gastrointestinal tract, heart, kidney, liver, lung, muscle, ovary, pancreas, parathyroid, penis, prostate, salivary glands, skin, spleen, testis, thymus, thyroid, and uterus; neurological disorders such as epilepsy, ischemic cerebrovascular disease, stroke, cerebral neoplasms, Alzheimer's disease, Pick's disease, Huntington's disease, dementia, Parkinson's disease and other extrapyramidal disorders, amyotrophic lateral sclerosis and other motor neuron disorders, progressive neural muscular atrophy, retinitis pigmentosa, hereditary ataxias, multiple sclerosis and other demyelinating diseases, bacterial and viral meningitis, brain abscess, subdural empyema, epidural abscess, suppurative intracranial thrombophlebitis, myelitis and radiculitis, viral central nervous system disease, prion diseases including kuru, Creutzfeldt-Jakob disease, and Gerstmann-Straussler-Scheinker syndrome, fatal familial insomnia, nutritional and metabolic diseases of the nervous system, neurofibromatosis, tuberous sclerosis, cerebelloretinal hemangioblastomatosis, encephalotrigeminal syndrome, mental retardation and other developmental disorders of the central nervous system, cerebral palsy, neuroskeletal disorders, autonomic nervous system disorders, cranial nerve disorders, spinal cord diseases, muscular dystrophy and other neuromuscular disorders, peripheral nervous system disorders, dermatomyositis and polymyositis, inherited, metabolic, endocrine, and toxic myopathies, myasthenia gravis, periodic paralysis, mental disorders including mood, anxiety, and schizophrenic disorders, akathesia, amnesia, catatonia, diabetic neuropathy, tardive dyskinesia, dystonias, paranoid psychoses, postherpetic neuralgia, and Tourette's disorder; and disorders of vesicular transport such as cystic fibrosis, glucose-galactose malabsorption syndrome, hypercholesterolemia, diabetes mellitus, diabetes insipidus, hyper- and hypoglycemia, Grave's disease, goiter, Cushing's disease, Addison's disease, gastrointestinal disorders including ulcerative colitis, gastric and duodenal ulcers, other conditions associated with abnormal vesicle trafficking including acquired immunodeficiency syndrome (AIDS), allergic reactions, autoimmune hemolytic anemia, proliferative glomerulonephritis, inflammatory bowel disease, multiple sclerosis, myasthenia gravis, rheumatoid arthritis, osteoarthritis, scleroderma, Chediak-Higashi syndrome, Sjogren's syndrome, systemic lupus erythiematosus, toxic shock syndrome, traumatic tissue damage, and viral, bacterial, fungal, helminthic, and protozoal infections, as well as additional indications listed for the individual NOVX clones.

The NOVX nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed. These also include potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), (v) an agent promoting tissue regeneration in vitro and in vivo, and (vi) a biological defense weapon.

Additional utilities for the NOVX nucleic acids and polypeptides according to the invention are disclosed herein.
NOV1

A disclosed NOV1 nucleic acid (SEQ ID NO:1) of 1138 nucleotides (also referred to as sggc_draft_ba186014_20000730_da1) encoding a novel LYSOSOMAL ACID LIPASE PRECURSOR-like protein is shown in Table 1A. An open reading frame was identified beginning with an ATG initiation codon at nucleotides 8–10 and ending with a TAA codon at nucleotides 1127–1129. Putative untranslated regions are found upstream from the initiation codon and downstream from the termination codon, and are underlined. The start and stop codons are shown in bold letters in Table 1A.

TABLE 1A

NOV1 nucleotide sequence.

GTCCAAAATGTGGCTGCTTTTAACAACAACTTGTTTGATCTGTGGAACTTTAAATGCTGGTGGAT (SEQ ID NO:1)

TCCTTGATTTGGAAAATGAAGTGAATCCTGAGGTGTGGATGAATACTAGTGAAATCATCATCTAC

AATGGCTACCCCAGTGAAGAGTATGAAGTCACCACTGAAGATGGGTATATACTCCTTGTCAACAG

AATTCCTTATGGGCGAACACATGCTAGGAGCACAGGTCCCCGGCCAGTTGTGTATATGCAGCATG

CCCTGTTTGCAGACAATGCCTACTGGCTTGAGAATTATGCTAATGGAAGCCTTGGATTCCTTCTA

GCAGATGCAGGTTATGATGTATGGATGGGAAACAGTCGGGGAAACACTTGGTCAAGAAGACACAA

AACACTCTCAGAGACAGATGAGAAATTCTGGGCCTTTGGTTTTGATGAAATGGCCAAATATGATC

TCCCAGGAGTAATAGACTTCATTGTAAATAAAACTGGTCAGGAGAAATTGTATTTCATTGGACAT

TCACTTGGCACTACAATAGGGTTTGTAGCCTTTTCCACCATGCCTGAACTGGCACAAAGAATCAA

AATGAATTTTGCCTTGGGTCCTACGATCTCATTCAAATATCCCACGGGCATTTTTACCAGGTTTT

TTCTACTTCCAAATTCCATAATCAAGGCTGTTTTTGGTACCAAAGGTTTCTTTTTAGAAGATAAG

AAAACGAAGATAGCTTCTACCAAAATCTGCAACAATAAGATACTCTGGTTGATATGTAGCGAATT

TATGTCCTTATGGGCTGGATCCAACAAGAAAAATATGAATCAGCTTTACCACTCTGATGAATTCA

GAGCTTATGACTGGGGAAATGACGCTGATAATATGAAACATTACAATCAGAGTCATCCCCCTATA

TATGACCTGACTGCCATGAAAGTGCCTACTGCTATTTGGGCTGGTGGACATGATGTCCTCGTAAC

ACCCCAGGATGTGGCCAGGATACTCCCTCAAATCAAGAGTCTTCATTACTTTAAGCTATTGCCAG

ATTGGAACCACTTTGATTTTGTCTGGGGCCTCGATGCCCCTCAACGGATGTACAGTGAAATCATA

GCTTTAATGAAGGCATATTCCTAAATGCAATGC

The NOV1 sequence of the invention and all the NOVX sequences described herein were derived by laboratory cloning of cDNA fragments covering the full length and/or part of the DNA sequence of the invention, and/or by in silico prediction of the full length and/or part of the DNA sequence of the invention from public human sequence databases.

A disclosed NOV1 polypeptide (SEQ ID NO:2) encoded by SEQ ID NO:1 has 373 amino acid residues and is presented in Table 1B using the one-letter amino acid code. SignalP, Psort and/or Hydropathy results predict that NOV1 has a signal peptide and is likely to be localized to the plasma membrane. In an alternative embodiment, NOV1 is likely to be localized to the lysosome (lumen) with a certainty of 0.5500. The most likely cleavage site for a NOV1 peptide is between amino acids 17 and 18, i.e., at the dash between amino acids LNA-GG. NOV1 has a molecular weight of 42681.4 Daltons.

TABLE 1B

Encoded NOV1 protein sequence.

MWLLLTTTCLICGTLNAGGFLDLENEVNPEVWMNTSEIIIYNGYPSEEYEVTTEDGYILLVNR     (SEQ ID NO:2)

IPYGRTHARSTGPRPVVYMQHALFADNAYWLENYANGSLGFLLADAGYDVWMGNSRGNTWSRR

HKTLSETDEKFWAFGFDEMAKYDLPGVIDFIVNKTGQEKLYFIGHSLGTTIGFVAFSTMPELA

QRIKMNFALGPTISFKYPTGIFTRFFLLPNSIIKAVFGTKGFFLEDKKTKIASTKICNNKILW

LICSEFMSLWAGSNKKNMNQLYHSDEFRAYDWGNDADNMKHYNQSHPPIYDLTAMKVPTAIWA

GGHDVLVTPQDVARILPQIKSLHYFKLLPDWNHFDFVWGLDAPQRMYSEIIALMKAYS

In all BLAST alignments herein, the "E-value" or "Expect" value is a numeric indication of the probability that the aligned sequences could have achieved their similarity to the BLAST query sequence by chance alone, within the database that was searched. The Expect value (E) is a parameter that describes the number of hits one can "expect" to see just by chance when searching a database of a particular size. It decreases exponentially with the Score (S) that is assigned to a match between two sequences. Essentially, the E value describes the random background noise that exists for matches between sequences.

The Expect value is used as a convenient way to create a significance threshold for reporting results. The default value used for blasting is typically set to 0.0001, with the filter to remove low complexity sequence turned off. In BLAST 2.0, the Expect value is also used instead of the P value (probability) to report the significance of matches. For example, an E value of one assigned to a hit can be interpreted as meaning that in a database of the current size one might expect to see one match with a similar score simply by chance. An E value of zero means that one would not expect to see any matches with a similar score simply by chance. See, e.g., http://www.ncbi.nlm.nih.gov/Education/BLASTinfo/. Occasionally, a string of X's or N's will result from a BLAST search. This is a result of automatic filtering of the query for low-complexity sequence that is performed to prevent artifactual hits The filter substitutes any low-complexity sequence that it finds with the letter "N" in nucleotide sequence (e.g., "NNNNNNNN") or the letter "X" in protein sequences (e.g., "XXX"). Low-complexity regions can result in high scores that reflect compositional bias rather than significant position-by-position alignment. *Wootton and Federhen*, Methods Enzymol 266:554–571, (1996).

In a search of sequence databases, it was found, for example, that the amino acid sequence of this invention has 154 of 297 bases (51%) identical to a ptnr:SPTREMBL-ACC:Q16529 LYSOSOMAL ACID LIPASE PRECURSOR—*Homo sapiens*.

In a further search of public sequence databases, NOV1 was found to have homology to the amino acid sequences shown in the BLASTP data listed in Table 1C.

TABLE 1C

BLASTP results for NOV1

| Gene Index/ Identifier | Protein/Organism | Length (aa) | Identity (%) | Positives (%) | Expect |
| --- | --- | --- | --- | --- | --- |
| ptnr: SPTREMBL-ACC: Q16529 | LYSOSOMAL ACID LIPASE PRECURSOR - *Homo sapiens* | 399 | 154/297 (51%) | 202/297 (68%) | 7.2e−109 |
| ptnr: pir-id: S41408 | lysosomal acid lipase (EC 3.1.1.-)/sterol esterase (EC 3.1.1.13) precursor - human | 399 | 154/297 (51%) | 202/297 (68%) | 1.2e−108 |
| ptnr: SWISSPROT-ACC: P38571 | Lysosomal acid lipase/cholesteryl ester hydrolase precursor (EC 3.1.1.13) (LAL) (Acid cholesteryl ester hydrolase) (Sterol esterase) (Lipase A) (Cholesteryl esterase) - *Homo sapiens* | 399 | 153/297 (51%) | 201/297 (67%) | 5.1e−108 |
| ptnr: SPTREMBL-ACC: Q96EJ0 | SIMILAR TO LIPASE A, LYSOSOMAL ACID, CHOLESTEROL ESTERASE (WOLMAN DISEASE) - *Homo sapiens* | 399 | 152/297 (51%) | 201/297 (67%) | 1.0e−107 |
| ptnr: SWISSPROT-ACC: P07098 | Triacylglycerol lipase, gastric precursor (EC 3.1.1.3) (Gastric lipase) (GL) - *Homo sapiens* | 398 | 146/297 (49%) | 196/297 (65%) | 5.8e−105 |

The homology of these sequences is shown graphically in the ClustalW analysis shown in Table 1D. In the ClustalW alignment of the NOV1 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be mutated to a much broader extent without altering protein structure or function. NOV1 polypeptide is provided in lane 1.

Table 1D. ClustalW Analysis of NOV1

1) NOV1 (SEQ ID NO:2)
2) Q16529 (SEQ ID NO:61)
3) S41408 (SEQ ID NO:62)
4) P38571 (SEQ ID NO:63)
5) Q96EJ0 (SEQ ID NO:64)
6) P07098 (SEQ ID NO:65)

```
                 10        20        30        40        50        60        70        80
        ....|....|....|....|....|....|....|....|....|....|....|....|....|....|....|....|
NOV1    --MWLLLTTTCLECGTLNAGGFLDLENEVNPEVWMNTSEIIYNGYPSEEYEVTEDGYILLVNRIPYGRTHARSTGPRP
Q16529  MKMRFLGLVVCLVLWILHSEGSRGKLTAVDPETNMNVSEIISYWGFPSEEYLVETEDGYILCLNRIPHGRKNHSDKGPKP
S41408  MKMRFLGLVVCLVLWTLHSEGSGGKLTAVDPETNMNVSEIISYWGFPSEEYLVETEDGYILCLNRIPHGRKNHSDKGPKP
P38571  MKMRFLGLVVCLVLWPLHSEGSGGKLTAVDPETNMNVSEIISYWGFPSEEYLVETEDGYILCLNRIPHGRKNHSDKGPKP
Q96EJ0  MKMRFLGLVVCLVLWPLHSEGSGGKLTAEDPETNMNVSEIISYWGFPSEEYLVETEDGYILCLNRIPHGRKNHSDKGPKP
P07098  --MWLLLTMASLISVLGTTHGLFGKLHPGSPEVTMNISQMIIYWGYPNEEYEVVTEDGYILEVNRIPYGKKNSGNTGQRP 90       100       110       120       130       140       150       160
        ....|....|....|....|....|....|....|....|....|....|....|....|....|....|....|....|
NOV1    VVYMQHALEADNAYWLENYANGSLGFILADAGYDVWMGNSRGNTWSRRHKTLSETDEKFWAFGDEMAKYDLPGVIDFIV
Q16529  VVFLQHGLLADSSNWVTNLANSSLGFILADAGFDVWMGNSRGNTWSRKHKTLSVSQDEFWAFSYDEMAKYDLPASINFIL
S41408  VVFLQHGLLADSSNWVTNLANSSLGFILADAGFDVWMGNSRGNTWSRKHKTLSVSQDEFWAFSYDEMAKYDLPASINFIL
P38571  VVFLQHGLLADSSNWVTNLANSSLGFILADAGFDVWMGNSRGNTWSRKHKTLSVSQDEFWAFSYDEMAKYDLPASINFIL
Q96EJ0  VVFLQHGLLADSSNWVTNLANSSLGFILADAGFDVWMGNSRGNTWSRKHKTLSVSQDEFWAFSYDEMAKYDLPASINFIL
P07098  VVFLQHGLLASATNWISNLPNNSLAFILADAGYDVWLGNSRGNTWARRNLYYSPDSVEFWAFSDEMAKYDLPAIIDFIV 170       180       190       200       210       220       230       240
        ....|....|....|....|....|....|....|....|....|....|....|....|....|....|....|....|
NOV1    NKTGQEKIYEIGHSLGTTIGFVAFSTMPELAQRIKMNFALGPTISFKVPTGIFTRFFLPNSIIKAVFGTFGFFLEDKKT
```

```
Q16529   NKTGQEQVYYVGHSQGTTIGFIAFSQIPELAKRIKMFFALGPVASVAFCTSPMAKLGRLPDHLIKDLFGDKEFLPQSAFL
S41408   NKTGQEQVYYVGHSQGTTIGFIAFSQIPELAKRIKMFFALGPVASVAFCTSPMAKLGRLPDHLIKDLFGDKEFLPQSAFL
P38571   NKTGQEQVYYVGHSQGTTIGFIAFSQIPELAKRIKMFFALGPVASVAFCTSPMAKLGRLPDHLIKDLFGDKEFLPQSAFL
Q96EJ0   NKTGQEQVYYVGHSQGTTIGFIAFSQIPELAKRIKMFFALGPVASVAFCTSPMAKLGRLPDHLIKDLFGDKEFLPQSAFL
P07098   KKTGQKQLHYVGHSQGTTIGFIAFSTNPSLAKRIKTFYALAPVAIVKYTKSLINKLRFVPQSLEKFIFGDKIFYHNFFD 250       260       270       280       290       300       310       320
                 ....|....|....|....|....|....|....|....|....|....|....|....|....|....|....|....|
NOV1     KIASTKICNNKILWLICSEFMSLWAGSNKKNMN-----------------------QLYHSDEFRAYDWGNDADNMKHY
Q16529   KWLGTHVCTHVILKELCGNLCFLLCGFNERNLNMSRVDVYTTHSPAGTSVQNMLHWSQAVKFQKFQAFDWGSSAKNYFHY
S41408   KWLGTHVCTHVILKELCGNLCFLLCGFNERNLNMSRVDVYTTHSPAGTSVQNMLHWSQAVKFQKFQAFDWGSSAKNYFHY
P38571   KWLGTHVCTHVILKELCGNLCFLLCGFNERNLNMSRVDVYTTHSPAGTSVQNMLHWSQAVKFQKFQAFDWGSSAKNYFHY
Q96EJ0   KWLGTHVCTHVILKELCGNLCFLLCGFNERNLNMSRVDVYTTHSPAGTSVQNMLHWSQAVKFQKFQAFDWGSSAKNYFHY
P07098   QFLATEVCSREMLNLLCSNALFIICGFDSKNFNTSRIDVYLSHNPAGTSVQNMFHWIQAVKSGKFQAYDWGSPVQNRMHY 330       340       350       360       370       380       390       400
                 ....|....|....|....|....|....|....|....|....|....|....|....|....|....|....|....|
NOV1     NQSHPFIYDITAMKVPTAIWAGGHDVLVTPQDVARILPQIKSLHYFKLLPDWNHFDFYWGLDAPQRMYSEIIALMKAYS-
Q16529   NQSYPPTYNVKDMLVPTAVWSGGHDWLADVYDVNILLTQITNLVFHESIPEWEHLDFIWGLDAPWRLYNKIINLMRKYQ-
S41408   NQSYPPTYNVKDMLVPTAVWSGGHDWLADVYDVNILLTQITNLVFHESIPEWEHLDFIWGLDAPWRLYNKIINLMRKYQ-
P38571   NQSYPPTYNVKDMLVPTAVWSGGHDWLADVYDVNILLTQITNLVFHESIPEWEHLDFIWGLDAPWRLYNKIINLMRKYQ-
Q96EJ0   NQSYPPTYNVKDMLVPTAVWSGGHDWLADVYDVNILLTQITNLVFHESIPEWEHLDFIWGLDAPWRLYNKIINLMRKYQ-
P07098   DQSQPPYYNVTAMNVFIAVWNGGKDLLALPQDVGLLLPKLFNLIYHKEIPFYNHLDFIWAMDAEQEVYNDIVSMISEDKK
```

BLAST analysis was performed on sequences from the Patp database, which is a proprietary database that contains sequences published in patents and patent publications. Patp results include those listed in Table 1E.

TABLE 1E

Patp BLASTP Analysis for NOV1

| Sequences producing High-scoring Segment Pairs | Protein/Organism | Length (aa) | Identity (%) | Positive (%) | E Value |
|---|---|---|---|---|---|
| patp: AAB66061 | Human lysosomal acid lipase protein - *Homo sapiens* | 399 | 153/297 (51%) | 201/297 (67%) | 3.9e−108 |
| patp: AAB90783 | Human shear stress-response protein SEQ ID NO: 66 - *Homo sapiens* | 399 | 153/297 (51%) | 201/297 (67%) | 3.9e−108 |
| patp: AAP60724 | Sequence of pregastric lipase - *Homo sapiens* | 398 | 146/297 (49%) | 196/297 (65%) | 4.5e−105 |
| patp: AAP60658 | Sequence of human pregastric lipase - *Homo sapiens* | 398 | 146/297 (49%) | 196/297 (65%) | 4.5e−105 |
| patp: AAW09383 | Human gastric lipase protein sequence - *Homo sapiens* | 398 | 146/297 (49%) | 196/297 (65%) | 4.5e−105 |

The presence of identifiable domains in NOV1, as well as all other NOVX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for NOV1 as disclosed in Tables 1F, were collected from the Conserved Domain Database (CDD) with Reverse Position Specific BLAST analyses. This BLAST analysis software samples domains found in the Smart and Pfam collections.

Table 1F lists the domain description from DOMAIN analysis results against NOV1. This indicates that the NOV1 sequence has properties similar to those of other proteins known to contain these domains. For Table 1F and all successive DOMAIN sequence alignments, fully conserved single residues are indicated by black shading or by the sign (|) and "strong" semi-conserved residues are indicated by gray shading or by the sign (+). In a sequence alignment herein, fully conserved single residues are calculated to determine percent homology, and conserved and "strong" semi-conserved residues are calculated to determine percent positives. The "strong" group of conserved amino acid residues may be any one of the following groups of amino acids: STA, NEQK, NHQK, NDEQ, QHRK, MILV, MILF, HY, FYW.

TABLE 1F

Domain Analysis of NOV1

| PSSMs producing significant alignments: | Score(bits) | Evalue |
|---|---|---|
| abhydrolase alpha/beta hydrolase fold | 64.8 | 1.8e−15 |

Parsed for domains:

| Model | Domain | seq-f | seq-t | hmm-f | hmm-t | score | E-value |
|---|---|---|---|---|---|---|---|
| abhydrolase | 1/1 | 111 | 366 .. | 1 | 232 [ ] | 64.8 | 1.8e−15 |

Alignments of top-scoring domains:

abhydrolase: domain 1 of 1, from 111 to 366

```
          (SEQ ID NO:66)       frvillDlrGfGeSsp..............sdlaeyrfddlaedleal
                                                    ++|++++  ||  +|+++++ ++++++
          ++|      ||   ++ +    NOV1   (SEQ ID NO:177)   111
          YDVWMGNSRGNTWSRRhktlsetdekfwaFGFDEMAKYDLPGVIDFI 157
```

TABLE 1F-continued

```
        ldalglekpvilvGhSmGGaialayaakyPel..rvkalvlvspp.....
        +++|+||  ++ +|||+|++|++ + ++ ||| +|+|+  +++|  + +
158     VNKTGQEK-LYFIGHSLGTTIGFVAFSTMPELaqRIKMNFALGPTisfky  206

......lpaglssdlfprqgnleglllanfrnrlsrsveallgralkgff
        +++  + +++|++ ++++  +++|++|+           ++ ++++  ++
207     ptgiftRFFLLPNSIIKAVFGTKGFFLEDKKT--KIASTKICNNKI--LW  252 llgrplvsdflkqaedwlsslirqgeddggdgllgaavalgkllqwdls.
        | +++++|   +  +++ ++|++   |  +++|+++  |++ + ++++ +++
253     LICSEFMSLWAGSNKKNMNQLYHSDEFRAYDWGNDADNMKHYNQSHPPIy  302 alkdikvPtlviwgtdDplvpldaseklsalipn.aevvviddagHlall
```

The nucleic acids and proteins of the invention are useful in potential diagnostic and therapeutic applications implicated in various diseases and disorders described below and/or other pathologies.

NOV2

A disclosed NOV2 nucleic acid (SEQ ID NO:3) of 12348 nucleotides (also referred to as 20708613_EXT1) encoding a novel MEGF/FLAMINGO/Cadherin-like protein is shown in Table 2A. An open reading frame was identified beginning with an ATG initiation codon at nucleotides 1–3 and ending with a TGA codon at nucleotides 12346–12348. The start and stop codons are shown in bold letters in Table 2A.

TABLE 2A

NOV2 nucleotide sequence.

ATGGCGAGGCGGCCGCCGTGGCGGGGCCTCGGGGAACGGTCGACCCCCATACTCCTGCTCCTTC (SEQ ID NO:3)
TCCTCTCTTTGTTCCCCCTCAGCCAGGAGGAGCTGGGGGGCGGTGGGCACCAGGGCTGGGACCC
AGGCTTAGCTGCCACTACGGGGCCAAGGGCGCATATCGGTGGCGGAGCCTTAGCTCTTTGTCCG
GAGTCTTCCGGGGTCCGGAGGATGGGGGGCCTGGCCTGGGGGTCAGGGAGCCTATCTTCGTGG
GGCTCCGAGGGAGAAGGCAAAGCGCCCGGAATAGTCGAGGGCCCCCTGAGCAGCCGAATGAGGA
GCTGGGGATTGAACACGGCGTCCAGCCATTGGGCAGCCGCGAACGAGAGACAGGACAGGGACCA
GGGTCTGTGTTATACTGGCGCCCAGAGGTCTCCTCTTGCGGGCGGACAGGACCTTTGCAAAGAG
GTAGTCTGTCACCAGGGGCTCTGTCCTCAGGGGTCCCGGGCTCGGGGAACAGCTCGCCCCTCCC
TTCAGACTTTTTGATTCGGCACCACGGTCCCAAGCCGGTGTCCTCCCAGCGGAACGCTGGGACA
GGCTCCCGCAAAAGAGTGGGCACCGCGCGCTGCTGTGGGGAATTATGGGCAACAGGGAGCAAGG
GTCAGGGCGAGAGAGCCACGACATCCGGAGCAGAAAGGACAGCCCCCCGGCGGAACTGTCTTCC
AGGGGCCTCGGGATCTGGCCCCGAGCTGGATTCAGCACCACGCACGGCGAGGACAGCTCCTGCA
TCAGGTTCAGCACCCCGCGAGTCTCGGACAGCTCCCGAGCCGGCGCCCAAGCGCATGCGCTCCC
GGGGTCTCTTCCGCTGCCGCTTCCTCCCGCAGCGCCCCGGGCCGCGTCCCCCGGGACTCCCGGC
CCGTCCTGAAGCCAGGAAAGTAACCTCGGCGAACCGGGCACGCTTTCGTCGCGCCGCAAACCGC
CACCCGCAGTTTCCGCAGTACAACTACCAGACGCTGGTGCCGGAGAATGAGGCAGCAGGCACCG
CGGTGCTACGCGTGGTTGCTCAGGACCCGGACGCCGGCGAGGCCGGGCGCCTAGTCTACTCGCT
GGCGGCACTCATGAACAGCCGCTCGCTGGAGCTGTTCAGCATCGACCCGCAGAGCGGCCTTATC
CGTACGGCGGCAGCTCTGGACCGCGAGAGCATGGAGCGTCACTACCTGCGTGTGACCGCGCAGG
ACCACGGGTCGCCGCGCCTCTCGGCCACCACGATGGTGGCCGTGACAGTAGCCGACCGCAACGA
CCACTCGCCGGTTTTTGAGCAAGCGCAGTACCGGGAGACCCTTCGCGAGAATGTGGAGGAGGGC
TACCCTATCCTGCAGCTGCGTGCCACTGACGGCGACGCGCCCCCAACGCCAACCTGCGCTACC
GCTTCGTGGGCCGCCAGCTGCGCGCGCTGCAGCTGCCGCCGCCTTCGAGATTGATCCACGCTC

TABLE 2A-continued

NOV2 nucleotide sequence.

CGGCCTCATCAGCACCAGCGGCCGAGTGGACCGCGAGCACATGGAAAGCTATGAGCTGGTGGTG
GAAGCCAGCGACCAGGGCCAGGAACCCGGGCCGCGCTCGGCCACTGTGCGCGTACACATAACTG
TGCTAGACGAGAACGACAATGCTCCTCAGTTCAGCGAGAAGCGCTACGTGGCGCAGGTGCGCGA
GGATGTGCGCCCCCACACAGTCGTGCTGCGCGTCACGGCCACTGACCGGGACAAGGACGCCAAC
GGATTGGTGCACTACAACATCATCAGTGGCAATAGCCGTGGACACTTTGCCATCGACAGCCTCA
CTGGCGAGATCCAGGTGGTGGCACCTCTGGACTTCGAGGCAGAGAGAGAGTATGCCTTGCGCAT
CAGGGCGCAGGATGCTGGCCGGCCACCGCTGTCCAACAACACGGGCCTGGCCAGCATCCAGGTG
GTGGACATCAATGACCACATTCCTATTTTTGTCAGCACGCCCTTCCAAGTTTCTGTCTTGGAAA
ATGCTCCCTTGGGTCACTCAGTCATCCACATTCAGGCAGTCGATGCAGACCATGGGAGAATGC
CAGATTGGAGTACTCCCTAACTGGTGTGGCACCTGATACTCCTTTTGTGATAAACAGCGCCACT
GGCTGGGTCTCTGTGAGTGGTCCCCTGGACCGTGAGTCTGTGGAGCATTACTTCTTTGGTGTGG
AGGCTCGAGACCATGGCTCACCCCCACTCTCTGCCTCAGCCAGTGTCACCGTGACTGTGCTGGA
CGTTAATGACAATCGGCCTGAGTTCACAATGAAGGAGTACCACCTACGACTGAATGAGGATGCA
GCTGTGGGCACCAGTGTGGTCAGCGTGACCGCAGTAGACCGTGATGCCAACAGTGCCATCAGCT
ACCAGATCACAGGCGGCAACACCCGGAATCGCTTTGCCATCAGCACCCAGGGGGTGTGGGTCT
GGTGACTCTGGCTCTGCCACTGGACTACAAGCAGGAACGCTACTTCAAGCTGGTACTAACTGCA
TCTGACCGTGCCCTTCATGATCACTGCTATGTGCACATCAACATCACAGATGCCAACACTCATC
GGCCGGTCTTTCAAAGTGCCCACTACTCAGTGAGTGTGAATGAAGATCGGCCAATGGGTAGCAC
CATAGTGGTCATCAGTGCCTCTGATGATGACGTGGGTGAGAATGCTCGTATCACCTATCTCCTG
GAGGACAACCTGCCCCAGTTCCGCATTGATGCAGACTCAGGAGCCATTACATTACAGGCCCCAT
TAGACTATGAGGACCAGGTGACCTACACCCTGGCTATCACAGCTCGGGACAATGGCATCCCACA
GAAGGCAGACACTACTTATGTGGAGGTGATGGTCAATGACGTGAATGACAATGCTCCACAATTT
GTGGCCTCCCACTATACAGGGCTGGTCTCTGAGGATGCCCCACCTTTCACCAGTGTCCTGCAGA
TCTCAGCCACTGACCGGGATGCTCATGCCAATGGCCGGGTCCAGTACACTTTCCAGAATGGTGA
AGATGGGGATGGAGATTTTACCATTGAGCCCACCTCTGGAATTGTCCGTACAGTAAGGCGGCTA
GACCGGGAGGCAGTATCAGTGTATGAGTTGACTGCCTACGCAGTGGACAGAGGTGTGCCCCCAC
TCCGGACTCCAGTCAGTATCCAGGTGATGGTGCAGGATGTGAACGACAATGCACCTGTCTTCCC
AGCTGAGGAGTTTGAGGTGCGGGTGAAAGAGAATAGCATTGTGGGCTCAGTGGTGGCCCAGATC
ACTGCAGTGGACCCTGACGAAGGCCCCAATGCCCATATAATGTACCAGATCGTGGAGGGGAACA
TCCCTGAGCTGTTCCAAATGGACATCTTCTCTGGAGAACTGACGGCACTCATTGACCTAGACTA
TGAGGCTCGCCAAGAATATGTGATTGTGGTGCAGGCCACATCTGCTCCTTTGGTCAGCCGGGCC
ACTGTGCACGTCCGCCTGGTTGACCAGAATGACAACAGCCCTGTGCTCAACAACTTCCAGATCC
TCTTCAACAACTATGTATCCAACCGTTCAGACACCTTCCCGTCGGGCATTATTGGGCGCATCCC
AGCTTATGACCCCGATGTCTCCGACCACCTCTTCTACTCCTTTGAGCGTGGCAATGAGCTGCAG
CTGCTGGTAGTCAACCAGACCAGTGGGGAGCTGCGACTCAGCCGAAAGCTAGACAATAACCGCC
CACTGGTGGCCTCCATGTTGGTGACTGTCACAGATGGCCTGCACAGCGTGACGGCGCAGTGTGT
GCTGCGCGTGGTCATCATCACGGAGGAGTTGCTGGCCAACAGCCTGACCGTGCGCCTTGAGAAC
ATGTGGCAGGAGCGCTTCCTGTCACCGCTGCTGGGCCGCTTCCTCGAGGGCGTGGCTGCGGTGC
TCGCTACGCCCGCTGAGGACGTCTTCATCTTCAACATCCAGAACGACACAGACGTAGGGGGCAC

TABLE 2A-continued

NOV2 nucleotide sequence.

```
CGTGCTCAATGTGAGTTTCTCGGCGCTAGCTCCACGTGGGGCCGGGGCGGGCGCTGCAGGGCCC
TGGTTCAGCTCCGAGGAGCTGCAGGAGCAGTTGTACGTGCGCCGGGCGGCGCTGGCGGCTCGCT
CCCTGCTCGACGTACTGCCCTTCGACGACAACGTGTGCCTGCGAGAGCCCTGTGAGAACTACAT
GAAATGCGTGTCCGTGCTCCGCTTTGACTCGTCCGCGCCCTTCCTGGCCTCGGCCTCCACGCTG
TTCCGACCCATCCAGCCCATCGCTGGCCTGCGCTGCCGCTGCCCGCCCGGATTCACGGGAGACT
TTTGCGAGACCGAGCTCGACCTCTGCTACTCCAACCCATGTCGCAACGGCGGAGCCTGCGCGCG
GCGCGAGGGAGGCTACACGTGCGTCTGCCGCCCGCGCTTCACCGGAGAGGACTGCGAGCTGGAC
ACCGAGGCCGGCCGCTGCGTGCCGGGCGTCTGCCGCAACGGGGGCACCTGCACCGACGCGCCCA
ACGGCGGCTTTCGCTGCCAGTGCCCGGCAGGCGGCGCCTTCGAGGGCCCGCGCTGCGAGGTGGC
TGCGCGCTCCTTCCCGCCCAGTTCGTTCGTCATGTTTCGCGGCCTGCGGCAGCGATTCCACCTT
ACGCTGTCCCTCTCGTTCGCGACAGTGCAGCAGAGCGGGCTGCTCTTCTACAACGGGCGCCTGA
ACGAGAAGCACGACTTCCTGGCCCTGGAACTCGTGGCTGGCCAAGTGCGGCTCACATATTCCAC
GGGTGAATCCAACACCGTGGTCAGCCCCACAGTTCCAGGGGGCTTGAGTGACGGGCAATGGCAT
ACAGTGCATCTGAGATACTACAACAAGCCCCGGACAGATGCCCTAGGGGGTGCACAGGGCCCT
CCAAGGACAAGGTGGCTGTGCTAAGCGTGGATGATTGTGATGTGGCCGTGGCTCTGCAGTTTGG
TGCTGAGATTGGCAACTACTCATGCGCGGCTGCTGGTGTGCAAACAAGCTCCAAGAAGTCCCTG
GACCTGACGGGCCCTCTTCTTCTGGGAGGTGTCCCCAACCTCCCCGAGAACTTCCCCGTATCCC
ATAAGGACTTCATCGGCTGTATGCGGGACCTGCACATTGATGGCCGCCGAGTGGACATGGCGGC
TTTTGTCGCAAATAATGGCACCATGGCAGGCTGCCAAGCCAAGCTACACTTTTGTGACTCAGGC
CCCTGCAAGAACAGTGGCTTCTGCTCGGAGCGCTGGGGCAGCTTCAGCTGCGACTGCCCTGTGG
GCTTCGGCGGCAAAGACTGTCAGCTTACTATGGCCCATCCCCACCATTTCCGTGGCAACGGCAC
ACTGAGCTGGAACTTTGGAAGTGACATGGCTGTGTCTGTGCCATGGTACCTGGGGCTGGCATTT
CGGACACGGGCAACGCAGGGGTCCTGATGCAAGTGCAGGCTGGGCCACACAGCACGCTCCTTT
GCCAGCTAGATCGGGGGTTACTGTCTGTGACAGTGACCAGGGGCTCGGGCCGTGCTTCCCATCT
CCTTCTGGACCAGGTGACTGTCAGTGATGGCCGGTGGCACGATCTGCGGCTGGAGTTGCAGGAG
GAACCAGGTGGCCGGCGGGCCACCATGTCCTTATGGTCTCACTGGACTTTAGCCTCTTCCAGG
ACACCATGGCGGTGGGGAGTGAGCTGCAGGGCCTGAAGGTAAAGCAGCTCCACGTGGGAGGCCT
GCCCCCCGGCAGTGCAGAGGAGGCTCCTCAGGGTCTGGTTGGCTGCATCCAGGGGTGTGGCTC
GGCTCCACACCCTCTGGCTCCCCGGCCCTGCTACCCCCCAGCCACCGAGTGAATGCGGAGCCTG
GCTGTGTTGTGACCAACGCCTGTGCCTCTGGGCCCTGCCCACCTCACGCAGACTGCCGGGACCT
CTGGCAGACCTTTTCTTGCACCTGCCAGCCAGGTTACTACGGCCCAGGCTGTGTGGATGCCTGC
CTCCTGAACCCCTGTCAGAACCAGGGATCATGCCGGCACCTGCCAGGAGCCCCCATGGCTATA
CCTGTGACTGTGTGGGTGGCTATTTCGGGCACCACTGTGAGCACAGGATGGACCAGCAGTGCCC
ACGGGGCTGGTGGGGAGCCCAACCTGTGGCCCCTGCAACTGTGATGTTCACAAAGGTTTTGAT
CCCAACTGCAACAAGACAAATGGGCAGTGTCACTGCAAGGAGTTCCACTACCGACCGCGGGGCA
GTGACTCTTGCCTCCCATGTGACTGCTACCCTGTGGGCTCCACCTCGCGCTCATGTGCACCCCA
CAGCGGGCAGTGCCCCTGTCGCCCAGGAGCCCTTGGCCGCCAGTGCAACAGCTGTGACAGTCCC
TTCGCAGAGGTGACAGCCAGCGGCTGCCGGGTGCTCTATGATGCCTGCCCTAAGTCCCTGAGAT
```

TABLE 2A-continued

NOV2 nucleotide sequence.

CTGGTGTGTGGTGGCCCCAGACAAAGTTTGGCGTCCTGGCCACAGTGCCCTGTCCCCGGGGGC
CCTGGGTGCTGCTGTGCGGCTGTGTGATGAGGCCCAGGGTTGGCTGGAGCCCGACCTCTTCAAC
TGTACCTCCCCTGCCTTTCGAGAGCTCAGTCTGCTGCTGGATGGCCTAGAGCTGAACAAGACGG
CACTGGATACCATGGAGGCCAAGAAGCTGGCTCAGCGGCTACGGGAGGTGACTGGCCACACTGA
CCACTATTTTAGCCAAGATGTTCGAGTCACTGCCCGCCTGCTGGCCCACCTGCTGGCCTTCGAG
AGCCATCAGCAGGGCTTCGGGCTGACAGCCACACAGGATGCCCACTTCAATGAGAATCTGCTGT
GGGCCGGCTCTGCACTGCTTGCCCCAGAGACAGGGGACTTGTGGGCGGCGCTGGGGCAGCGGGC
CCCTGGGGGCTCCCCAGGCAGCGCGGGACTGGTGAGGCACCTGGAGGAGTATGCAGCCACACTC
GCAAGGAATATGGAACTCACATACCTGAATCCCATGGGGCTGGTGACGCCTAATATCATGCTCA
GCATTGACCGCATGGAGCACCCCAGTTCTCCCCGGGGGGCCCGTCGCTACCCTCGCTACCATAG
CAACCTCTTTCGAGGCCAGGATGCCTGGGATCCTCACACCCATGTGCTGCTGCCTTCCCAGTCC
CCACGGCCATCCCCATCTGAAGTTCTGCCCACAAGCAGCAGCATAGAAAACTCCACCACCTCAA
GTGTGGTCCCCCCACCAGCCCCGCCAGAGCCAGAGCCTGGGATCTCCATTATCATTCTCCTCGT
TTACCGCACCTTAGGGGGACTGCTCCCTGCCCAGTTCCAGGCAGAACGCCGAGGTGCCAGGCTT
CCTCAGAACCCCGTCATGAACTCCCCGGTGGTCAGCGTGGCTGTGTTCCACGGACGCAACTTCC
TAAGGGGAATCCTGGAGTCCCCCATCAGCCTAGAGTTTCGCCTGCTACAGACAGCGAATCGGAG
CAAGGCGATCTGTGTGCAGTGGGACCCACCTGGCCTGGCGGAGCAGCATGGTGTGTGGACAGCA
CGGGACTGCGAGCTGGTGCACAGGAATGGGTCCCACGCACGGTGTCGCTGCAGCCGGACAGGGA
CCTTTGGGGTCCTCATGGATGCCTCTCCCGTGAGAGGCTGGAGGGCGACCTGGAGCTGCTGGC
TGTGTTCACCCACGTGGTCGTGGCTGTGTCTGTGGCTGCGCTGGTGCTGACTGCAGCCATCCTG
CTGAGCCTGCGCAGCCTCAAGTCCAATGTGCGTGGGATCCATGCCAATGTGGCAGCCGCCCTGG
GGGTGGCAGAGCTCCTCTTCCTGCTGGGGATTCACAGGACCCACAATCAGGTGCAGGATCAGGG
CCAGGGAACTTGTGTCCTGATGACCCTACTGGCCCAGGAGGCCTGGGGCCAAAACTCAGGGTCA
GAGCTGGTGTGCACTGCAGTCGCCATCCTCCTGCACTACTTCTTCCTCAGCACCTTCGCGTGGC
TCTTCGTGCAGGGGCTGCACCTCTACCGCATGCAGGTTGAGCCACGCAACGTGGACCGCGGCGC
CATGCGCTTCTACCATGCCCTGGGCTGGGGCGTCCCTGCTGTGCTGCTGGGCCTTGCTGTGGGC
CTGGACCCTGAGGGCTATGGGAACCCTGACTTCTGCTGGATCTCAGTCCACGAGCCCCTCATCT
GGAGCTTTGCTGGCCCTGTTGTCCTGGTCATAGTGATGAACGGGACCATGTTTCTCCTCGCTGC
CCGCACATCCTGCTCCACAGGGCAGAGGGAGGCCAAGAAGACCTCTGCACTCAGGACCCTTCGC
AGCTCCTTCCTGCTGCTTCTGCTGGTCAGTGCCTCCTGGCTCTTTGGGCTCCTGGCAGTCAACC
ACAGCATCCTAGCCTTCCACTACCTCCATGCTGGACTCTGCGGCCTCCAGGGCCTGGCGGTGCT
GCTGCTCTTCTGTGTCCTAAATGCAGATGCTCGGGCTGCCTGGATGCCAGCCTGTCTGGGCAGG
AAGGCAGCGCCTGAGGAGGCAAGGCCAGCACCTGGGCTGGGACCTGGCGCCTACAACAACACGG
CTCTCTTTGAGGAGAGTGGCCTCATCCGCATCACTCTGGGCGCCTCCACCGTCTCCTCTGTGAG
CAGTGCCCGCTCCGGCCGGACCCAGGACCAGGACAGCCAGCGGGCCGCAGCTACCTCAGGGAC
AATGTCCTGGTTCGACATGGCTCAGCCGCTGACCACACTGACCACAGCCTCCAGGCTCATGCTG
GCCCCACTGACCTGGACGTGGCCATGTTCCATCGAGATGCTGGCGCAGACTCCGACTCTGACAG
TGACCTGTCCTTGGAGGAGGAGAGGAGTCTCTCCATTCCATCTTCAGAAAGCGAGGACAATGGC
CGGACGCGGGGGCGCTTCCAACGGCCACTCTGCCGAGCAGCCCAGAGTGAGAGGCTCCTCACCC

TABLE 2A-continued

NOV2 nucleotide sequence.

ACCCCAAAGATGTGGATGGCAATGACCTCCTGTCCTACTGGCCAGCCCTGGGGGAGTGCGAGGC
AGCCCCCTGTGCTCTGCAGACTTGGGGCTCTGAAAGGCGCCTGGGGCTGGACACCAGCAAGGAT
GCAGCTAACAACAACCAGCCAGACCCGGCCCTGACCAGTGGGGATGAGACTTCTCTGGGCCGGG
CCCAGCGCCAGAGGAAAGGCATCCTGAAGAACCGGTTGCAATACCCACTGGTGCCACAGACCCG
AGGTGCCCCTGAGCTGTCCTGGTGCCGTGCAGCCACCTTGGGCCACCGTGCAGTGCCAGCTGCC
TCTTACGGTCGCATCTATGCTGGCGGGGCACGGGCAGCCTTTCACAGCCAGCCAGCCGCTACT
CTTCTAGAGAACAGCTGGACCTGCTCCTCCGGCGGCAACTGAGCCGTGAGCGACTAGAGGAAGC
CCCTGCCCCTGTTCTACGTCCCCTGAGCCGGCCAGGGTCCCAGGAATGCATGGATGCTGCACCA
GGCCGACTGGAGCCCAAAGATCGGGGCAGCACCCTGCCACGGAGGCAGCCACCTCGGGACTACC
CTGGCGCCATGGCTGGCCGCTTCGGGTCACGGGATGCGCTCGACTTAGGGGCACCTCGAGAGTG
GTTGAGCACGCTGCCTCCGCCCCGCCGCACCCGGGACCTTGACCCACAGCCCCCACCTCTGCCC
CTGTCTCCCCAGCGGCAACTCTCAAGGGACCCCCTCTTGCCATCCCGGCCGCTGGACTCTCTGT
CTAGGAGCTCGAACTCTCGGGAGCAGCTGGACCAGGTGCCTAGCCGGCACCCCTCACGAGAAGC
CCTTGGGCCACTCCCGCAGCTGCTCAGAGCTAGGGAGGACTCGGTCAGTGGCCCCAGCCATGGC
CCCTCCACAGAACAGTTGGACATTCTTTCCTCCATCCTTGCCTCTTTCAACTCCTCGGCCCTCT
CCTCTGTGCAATCTTCAAGCACACCCTTGGGCCCTCACACCACTGCCACACCTTCTGCCACAGC
CTCTGTGCTTGGGCCCTCCACGCCACGTTCTGCCACGTCTCACAGCATCTCGGAGCTGTCGCCA
GACTCAGAACCGAGGGACACACAGGCACTGCTGTCTGCAACACAAGCAATGGACCTGCGGAGGC
GAGACTACCACATGGAACGGCCGCTGCTGAACCAGGAGCATTTGGAGGAGCTGGGGCGCTGGGG
CTCAGCACCTAGGACCCACCAGTGGCGGACCTGGTTGCAGTGCTCCCGTGCTCGGGCCTATGCC
CTTCTGCTCCAACACCTCCCGGTTTTGGTCTGGTTACCCCGGTATCCTGTGCGTGACTGGCTCC
TGGGTGACCTGTTATCCGGCCTGAGTGTGGCCATCATGCAGCTTCCGCAGGGCTTGGCCTACGC
CCTCCTGGCTGGATTGCCCCCCGTGTTTGGCCTCTATAGCTCCTTCTACCCTGTCTTCATCTAC
TTCCTGTTTGGCACTTCCCGGCACATCTCCGTGGAGAGCCTCTGTGTCCCGGGACCAGTAGACA
CAGGGACCTTTGCTGTCATGTCTGTGATGGTGGGCAGTGTGACAGAATCCCTGGCCCCGCAGGC
CTTGAACGACTCCATGATCAATGAGACAGCCAGAGATGCTGCCCGGGTACAGGTGGCCTCCACA
CTCAGTGTCCTGGTTGGCCTCTTCCAGGTGGGCTGGGCCTGATCCACTTCGGCTTCGTGGTCA
CCTACCTGTCAGAACCTCTTGTCCGAGGCTATACCACAGCTGCAGCTGTGCAGGTCTTCGTCTC
ACAGCTCAAGTATGTGTTTGGCCTCCATCTGAGCAGCCACTCTGGGCCACTGTCCCTCATCTAT
ACAGTGCTGGAGGTCTGCTGGAAGCTGCCCCAGAGCAAGGTTGGCACCGTGGTCACTGCAGCTG
TGGCTGGGGTGGTGCTCGTGGTGGTGAAGCTGTTGAATGACAAGCTGCAGCAGCAGCTGCCCAT
GCCGATACCCGGGGAGCTGCTCACGCTCATCGGGGCCACAGGCATCTCCTATGGCATGGGTCTA
AAGCACAGATTTGAGGTAGATGTCGTGGGCAACATCCCTGCAGGGCTGGTGCCCCAGTGGCCC
CCAACACCCAGCTGTTCTCAAAGCTCGTGGGCAGCGCCTTCACCATCGCTGTGGTTGGGTTTGC
CATTGCCATCTCACTGGGGAAGATCTTCGCCCTGAGGCACGGCTACCGGGTGGACAGCAACCAG
GAGCTGGTGGCCCTGGGCCTCAGTAACCTTATCGGAGGCATCTTCCAGTGCTTCCCCGTGAGTT
GCTCTATGTCTCGGAGCCTGGTACAGGAGAGCACCGGGGCAACTCGCAGGTTGCTGGAGCCAT
CTCTTCCCTTTTCATCCTCCTCATCATTGTCAAACTTGGGGAACTCTTCCATGACCTGCCCAAG

TABLE 2A-continued

NOV2 nucleotide sequence.

GCGGTCCTGGCAGCCATCATCATTGTGAACCTGAAGGGCATGCTGAGGCAGCTCAGCGACATGC

GCTCCCTCTGGAAGGCCAATCGGGCGGATCTGCTTATCTGGCTGGTGACCTTCACGGCCACCAT

CTTGCTGAACCTGGACCTTGGCTTGGTGGTTGCGGTCATCTTCTCCCTGCTGCTCGTGGTGGTC

CGGACACAGATGCCCCACTACTCTGTCCTGGGGCAGGTGCCAGACACGGATATTTACAGAGATG

TGGCAGAGTACTCAGAGGCCAAGGAAGTCCGGGGGGTGAAGGTCTTCCGCTCCTCGGCCACCGT

GTACTTTGCCAATGCTGAGTTCTACAGTGATGCGCTGAAGCAGAGGTGTGGTGTGGATGTCGAC

TTCCTCATCTCCCAGAAGAAGAAACTGCTCAAGAAGCAGGAGCAGCTGAAGCTGAAGCAACTGC

AGAAAGAGGAGAAGCTTCGGAAACAGGCAGGGCCCCTTTTGTCTGCATGTCTGGCTCCCCAGCA

GGTGAGCTCAGGAGATAAGATGGAAGATGCAACAGCCAATGGTCAAGAAGACTCCAAGGCCCCA

GATGGGTCCACACTGAAGGCCCTGGGCCTGCCTCAGCCAGACTTCCACAGCCTCATCCTGGACC

TGGGTGCCCTCTCCTTTGTGGACACTGTGTGCCTCAAGAGCCTGAAGAATATTTTCCATGACTT

CCGGGAGATTGAGGTGGAGGTGTACATGGCGGCCTGCCACAGCCCTGTGGTCAGCCAGCTTGAG

GCTGGGCACTTCTTCGATGCATCCATCACCAAGAAGCATCTCTTTGCCTCTGTCCATGATGCTG

TCACCTTTGCCCTCCAACACCCGAGGCCTGTCCCGACAGCCCTGTTTCGCCCTCACTCGCTGT

CTCCTCAGATGTGAAACAGTTGGAACCAGAGCTGCTTCTCAGGAATAATTTGCTCTCAGGAATA

CCCGAGAAGGTACAGGGCAGCGTGGGTGCCAATGGGCAGTCCCTGGAGGATACAGAGTGA

The chromosomal locus for 20708613_EXT1 is 3p21.3-4. This information was assigned using OMIM, the electronic northern bioinformatic tool implemented by CuraGen Corporation, public ESTs, public literature references and/or genomic clone homologies. This was executed to derive the chromosomal mapping of the SeqCalling assemblies, Genomic clones, literature references and/or EST NOVX sequences that are included in the invention.

In a search of sequence databases, it was found, for example, BlastX analysis of 20708613_EXT1 showed that there was 94% (2449/2599 bp) homology to *Rattus norvegicus* protein MEGF (SPTREMBL-ACC:O088278). MEGF stands for multiple epidermal growth factor repeat containing protein. 20708613_EXT1 also showed 70% (1684/2384 bp) homology to *Mus musculus* protein FLAMINGO 1 (TREMBLNEW-ACC: BAA84070).

A disclosed NOV2 polypeptide (SEQ ID NO:4) encoded by SEQ ID NO:3 has 4115 amino acid residues and is presented in Table 2B using the one-letter amino acid code. NOV2 is likely a Type IIIa membrane protein (clv). SignalP, Psort and/or Hydropathy results predict that NOV2 has a signal peptide and is likely to be localized plasma membrane with a certainty of 0.8200. In an alternative embodiment, NOV2 is likely to be localized to the Golgi body with a certainty of 0.4600, or to the endoplasmic reticulum (membrane) with a certainty of 0.3700, or to the endoplasmic reticulum (lumen) with a certainty of 0.1000. The most likely cleavage site for a NOV2 peptide is between amino acids 31 and 32, i.e., at the dash between amino acids SQE-EL.

TABLE 2B

Encoded NOV2 protein sequence.

MARRPPWRGLGERSTPILLLLLLSLFPLSQEELGGGHQGWDPGLAATTGPRAHIGGGALALCP  (SEQ ID NO:4)

ESSGVREDGGPGLGVREPIFVGLRGRRQSARNSRGPPEQPNEELGIEHGVQPLGSRERETGQGP

GSVLYWRPEVSSCGRTGPLQRGSLSPGALSSGVPGSGNSSPLPSDFLIRHHGPKPVSSQRNAGT

GSRKRVGTARCCGELWATGSKGQGERATTSGAERTAPRRNCLPGASGSGPELDSAPRTARTAPA

SGSAPRESRTAPEPAPKRMRSRGLFRCRFLPQRPGPRPPGLPARPEARKVTSANRARFRRAANR

HPQFPQYNYQTLVPENEAAGTAVLRVVAQDPDAGEAGRLVYSLAALMNSRSLELFSIDPQSGLI

RTAAALDRESMERHYLRVTAQDHGSPRLSATTMVAVTVADRNDHSPVFEQAQYRETLRENVEEG

YPILQLRATDGDAPPNANLRYRFVGPPAARAAAAAAFEIDPRSGLISTSGRVDREHMESYELVV

EASDQGQEPGPRSATVRVHITVLDENDNAPQFSEKRYVAQVREDVRPHTVVLRVTATDRDKDAN

TABLE 2B-continued

Encoded NOV2 protein sequence.

GLVHYNIISGNSRGHFAIDSLTGEIQVVAPLDFEAEREYALRIRAQDAGRPPLSNNTGLASIQV
VDINDHIPIFVSTPFQVSVLENAPLGHSVIHIQAVDADHGENARLEYSLTGVAPDTPFVINSAT
GWVSVSGPLDRESVEHYFFGVEARDHGSPPLSASASVTVTVLDVNDNRPEFTMKEYHLRLNEDA
AVGTSVVSVTAVDRDANSAISYQITGGNTRNRFAISTQGGVGLVTLALPLDYKQERYFKLVLTA
SDRALHDHCYVHINITDANTHRPVFQSAHYSVSVNEDRPMGSTIVVISASDDDVGENARITYLL
EDNLPQFRIDADSGAITLQAPLDYEDQVTYTLAITARDNGIPQKADTTYVEVMVNDVNDNAPQF
VASHYTGLVSEDAPPFTSVLQISATDRDAHANGRVQYTFQNGEDGDGDFTIEPTSGIVRTVRRL
DREAVSVYELTAYAVDRGVPPLRTPVSIQVMVQDVNDNAPVFPAEEFEVRVKENSIVGSVVAQI
TAVDPDEGPNAHIMYQIVEGNIPELFQMDIFSGELTALIDLDYEARQEYVIVVQATSAPLVSRA
TVHVRLVDQNDSPVLNNFQILFNNYVSNRSDTFPSGIIGRIPAYDPDVSDHLFYSFERGNELQ
LLVVNQTSGELRLSRKLDNNRPLVASMLVTVTDGLHSVTAQCVLRVVIITEELLANSLTVRLEN
MWQERFLSPLLGRFLEGVAAVLATPAEDVFIFNIQNDTDVGGTVLNVSFSALAPRGAGAGAAGP
WFSSEELQEQLYVRRAALAARSLLDVLPFDDNVCLREPCENYMKCVSVLRFDSSAPFLASASTL
FRPIQPIAGLRCRCPPGFTGDFCETELDLCYSNPCRNGGACARREGGYTCVCRPRFTGEDCELD
TEAGRCVPGVCRNGGTCTDAPNGGFRCQCPAGGAFEGPRCEVAARSFPPSSFVMFRGLRQRFHL
TLSLSFATVQQSGLLFYNGRLNEKHDFLALELVAGQVRLTYSTGESNTVVSPTVPGGLSDGQWH
TVHLRYYNKPRTDALGGAQGPSKDKVAVLSVDDCDVAVALQFGAEIGNYSCAAAGVQTSSKKSL
DLTGPLLLGGVPNLPENFPVSHKDFIGCMRDLHIDGRRVDMAAFVANNGTMAGCQAKLHFCDSG
PCKNSGFCSERWGSFSCDCPVGFGGKDCQLTMAHPHHFRGNGTLSWNFGSDMAVSVPWYLGLAF
RTRATQGVLMQVQAGPHSTLLCQLDRGLLSVTVTRGSGRASHLLLDQVTVSDGRWHDLRLELQE
EPGGRRGHHVLMVSLDFSLFQDTMAVGSELQGLKVKQLHVGGLPPGSAEEAPQGLVGCIQGVWL
GSTPSGSPALLPPSHRVNAEPGCVVTNACASGPCPPHADCRDLWQTFSCTCQPGYYGPGCVDAC
LLNPCQNQGSCRHLPGAPHGYTCDCVGGYFGHHCEHRMDQQCPRGWWGSPTCGPCNCDVHKGFD
PNCNKTNGQCHCKEFHYRPRGSDSCLPCDCYPVGSTSRSCAPHSGQCPCRPGALGRQCNSCDSP
FAEVTASGCRVLYDACPKSLRSGVWWPQTKFGVLATVPCPRGALGAAVRLCDEAQGWLEPDLFN
CTSPAFRELSLLLDGLELNKTALDTMEAKKLAQRLREVTGHTDHYFSQDVRVTARLLAHLLAFE
SHQQGFGLTATQDAHFNENLLWAGSALLAPETGDLWAALGQRAPGGSPGSAGLVRHLEEYAATL
ARNMELTYLNPMGLVTPNIMLSIDRMEHPSSPRGARRYPRYHSNLFRGQDAWDPHTHVLLPSQS
PRPSPSEVLPTSSSIENSTTSSVVPPPAPPEPEPGISIIILLVYRTLGGLLPAQFQAERRGARL
PQNPVMNSPVVSVAVFHGRNFLRGILESPISLEFRLLQTANRSKAICVQWDPPGLAEQHGVWTA
RDCELVHRNGSHARCRCSRTGTFGVLMDASPRERLEGDLELLAVFTHVVVAVSVAALVLTAAIL
LSLRSLKSNVRGIHANVAAALGVAELLFLLGIHRTHNQVQDGQGTCVLMTLLAQEAWGQNSGS
ELVCTAVAILLHYFFLSTFAWLFVQGLHLYRMQVEPRNVDRGAMRFYHALGWGVPAVLLGLAVG
LDPEGYGNPDFCWISVHEPLIWSFAGPVVLVIVMNGTMFLLAARTSCSTGQREAKKTSALRTLR
SSFLLLLLVSASWLFGLLAVNHSILAFHYLHAGLCGLQGLAVLLLFCVLNADARAAWMPACLGR
KAAPEEARPAPGLGPGAYNNTALFEESGLIRITLGASTVSSVSSARSGRTQDQDSQRGRSYLRD
NVLVRHGSAADHTDHSLQAHAGPTDLDVAMFHRDAGADSDSDSDLSLEEERSLSIPSSESEDNG
RTRGRFQRPLCRAAQSERLLTHPKDVDGNDLLSYWPALGECEAAPCALQTWGSERRLGLDTSKD

TABLE 2B-continued

Encoded NOV2 protein sequence.

AANNNQPDPALTSGDETSLGRAQRQRKGILKNRLQYPLVPQTRGAPELSWCRAATLGHRAVPAA

SYGRIYAGGGTGSLSQPASRYSSREQLDLLLRRQLSRERLEEAPAPVLRPLSRPGSQECMDAAP

GRLEPKDRGSTLPRRQPPRDYPGAMAGRFGSRDALDLGAPREWLSTLPPPRRTRDLDPQPPPLP

LSPQRQLSRDPLLPSRPLDSLSRSSNSREQLDQVPSRHPSREALGPLPQLLRAREDSVSGPSHG

PSTEQLDILSSILASFNSSALSSVQSSSTPLGPHTTATPSATASVLGPSTPRSATSHSISELSP

DSEPRDTQALLSATQAMDLRRRDYHMERPLLNQEHLEELGRWGSAPRTHQWRTWLQCSRARAYA

LLLQHLPVLVWLPRYPVRDWLLGDLLSGLSVAIMQLPQGLAYALLAGLPPVFGLYSSFYPVFIY

FLFGTSRHISVESLCVPGPVDTGTFAVMSVMVGSVTESLAPQALNDSMINETARDAARVQVAST

LSVLVGLFQVGLGLIHFGFVVTYLSEPLVRGYTTAAAVQVFVSQLKYVFGLHLSSHSGPLSLIY

TVLEVCWKLPQSKVGTVVTAAVAGVVLVVVKLLNDKLQQQLPMPIPGELLTLIGATGISYGMGL

KHRFEVDVVGNIPAGLVPPVAPNTQLFSKLVGSAFTIAVVGFAIAISLGKIFALRHGYRVDSNQ

ELVALGLSNLIGGIFQCFPVSCSMSRSLVQESTGGNSQVAGAISSLFILLIIVKLGELFHDLPK

AVLAAIIIVNLKGMLRQLSDMRSLWKANRADLLIWLVTFTATILLNLDLGLVVAVIFSLLLVVV

RTQMPHYSVLGQVPDTDIYRDVAEYSEAKEVRGVKVFRSSATVYFANAEFYSDALKQRCGVDVD

FLISQKKKLLKKQEQLKLKQLQKEEKLRKQAGPLLSACLAPQQVSSGDKMEDATANGQEDSKAP

DGSTLKALGLPQPDFHSLILDLGALSFVDTVCLKSLKNIFHDFREIEVEVYMAACHSPVVSQLE

AGHFFDASITKKHLFASVHDAVTFALQHPRPVPDSPVSPSLAVSSDVKQLEPELLLRNNLLSGI

PEKVQGSVGANGQSLEDTE

The full amino acid sequence of the protein of the invention was found to have 2376 of 2599 amino acid residues (91%) identical to, and 2449 of 2599 residues (94%) positive with, the amino acid residue protein from *Rattus norvegicus* ptnr: SPTREMBL-ACC:O88278 MEGF2.

In a further search of public sequence databases, NOV2 was found to have homology to the amino acid sequences shown in the BLASTP data listed in Table 2C.

TABLE 2C

BLASTP results for NOV2

| Gene Index/ Identifier | Protein/Organism | Length (aa) | Identity (%) | Positives (%) | Expect |
| --- | --- | --- | --- | --- | --- |
| ptnr: SPTREMBL-ACC: Q9NYQ7 | PROTOCADHERIN FLAMINGO 1 - *Homo sapiens* | 3312 | 2601/2618 (99%) | 2604/2618 (99%) | 0.0 |
| ptnr: SPTREMBL-ACC: Q91ZI0 | CADHERIN EGF LAG SEVEN-PASS G-TYPE RECEPTOR - *Mus musculus* | 3301 | 2392/2618 (91%) | 2469/2618 (94%) | 0.0 |
| ptnr: SPTREMBL-ACC: O88278 | MEGF2 - *Rattus norvegicus* | 3313 | 2376/2599 (91%) | 2449/2599 (94%) | 0.0 |
| ptnr: SPTREMBL-ACC: Q9HCU4 | FLAMINGO 1 - *Homo sapiens* | 2923 | 1345/2330 (57%) | 1681/2330 (72%) | 0.0 |
| ptnr: SPTREMBL-ACC: Q9R0M0 | FLAMINGO 1 - *Mus musculus* | 2920 | 1348/2384 (56%) | 1684/2384 (70%) | 0.0 |

The homology of these sequences is shown graphically in the ClustalW analysis shown in Table 2D. The NOV2 polypeptide is provided in lane 1.

Table 2D. ClustalW Analysis of NOV2

1) NOV2 (SEQ ID NO:4)
2) Q9NYQ7 (SEQ ID NO:67)
3) Q91ZI0 (SEQ ID NO:68)
4) O88278 (SEQ ID NO:69)
5) Q9HCU4 (SEQ ID NO:70)
6) Q9R0M0 (SEQ ID NO:71)

```
               10        20        30        40        50        60        70        80
         ....|....|....|....|....|....|....|....|....|....|....|....|....|....|....|....|
NOV2     -MARREPWRGLGERSTPILLLLLLSLFPLSQEELGGGHQGWDPGLAATTGPRAHIGGGAIALCPESSGVREDGGPGLGV
Q9NYQ7   MMARREPWRGLGERSTPILLLLLLSLFPLSQEELGGGHQGWDPGLAATTGPRAHIGGGAIALCPESSGVREDGGPGLGV
Q91ZI0   -MARRPLWGLPGPSTPVLLLLLLSLFPFSREELGGGGDQDWDPGVATTTGPRAQIGSGAVALCPESPGVWEDGDPGLGV
O88278   -MARREPLWWGLPGPSTPILLLLLFSLFPSSREEMGGGGDQGWDPGVATATGPRAQIGSGAVALCPESPGVWEDGDPGLGV
Q9HCU4   -MRSPATGVPLPTPPPPLLLLLLLLLPP----PLLG-----------DQVGPCRSLGS---------------------
Q9R0M0   -MRTRAASAPLPTBLLPLLLLLLLLPPS----PLLG-----------DQVGPCRSLGS---------------------

90       100       110       120       130       140       150       160
         ....|....|....|....|....|....|....|....|....|....|....|....|....|....|....|....|
NOV2     REPIFVGLRGRRQSARNSRGPPEQPNEELGIEHGVQPLGSRERETGQGPGSVLYWRPEVSSCGRTGPLQRGSLSPGALSS
Q9NYQ7   REPIFVGLRGRRQSARNSRGPPEQPNEELGIEHGVQPLGSRERETGQGPGSVLYWRPEVSSCGRTGPLQRGSLSPGALSS
Q91ZI0   REPVFMRLRVGRQNARNGRGAPEQPNAEV----VVQALGSREQBAGQGPGYLLCWHPEISSCGRTGPLRRGSLPLDALSP
O88278   REPVFMKLPVGRQNARNGRGAPEQPNREP----VVQALGSREQBAGQGSGYLLCWHPEISSCGRTGHLRRGSLPLDALSP
Q9HCU4   ----------RGRCSSG-------------ACAPVG------WLCPSSASNLWLYTSRCRDAGTELTG-----HLVP
Q9R0M0   ----------GGRSSSG-------------ACAPVG------WLCPASASNLWLYTSRCRESGIELTG-----HLVP 170       180       190       200       210       220       230       240
         ....|....|....|....|....|....|....|....|....|....|....|....|....|....|....|....|
NOV2     GVPGSGNSSPLPSDFLIRHHGPKPVSSQRNAGTGSRKRVGTARCCGELWATGSKGQGERATTSGAERTAPRRNCLPGASG
Q9NYQ7   GVPGSGNSSPLPSDFLIRHHGPKPVSSQRNAGTGSRKRVGTARCCGELWATGSKGQGERATTSGAERTAPRRNCLPGASG
Q91ZI0   GDSDLRNSSPHPSRLLACPDGSPPVAFQRNARRSIRKRVETSRCCCGKLWEPGHKGQGERSATSTVDRGPFRRDCLPGSLG
O88278   GDSDLRNSSPHPSELLACPDSPRPVAFQRNGRRSIRKRVETFRCCCGKLWEPCHKGQGERSATSTVDRGPLRRDCLPGSLG
Q9HCU4   HHDGLRVWCPESEAHIPLPPAPS---------GCP---------WSCRLLGIGGHLSPQGKLTLPEEHPCLK----
Q9R0M0   HHDGLRVWCPESGAHIPLPPSSE---------GCP---------WSCRLLGIGGHLSPQGTLTLPEEHPCLK----

250       260       270       280       290       300       310       320
         ....|....|....|....|....|....|....|....|....|....|....|....|....|....|....|....|
NOV2     SGPELDSAPRTARTAPASGSAPRESRTAPEPAPKRMRSRGLFRCRFLPQRPGPRPPGLPARPEARKVISANRARPRRAAN
Q9NYQ7   SGPELDSAPRTARTAPASGSAPRESRTAPEPAPKRMRSRGLFRCRFLPQRPGPRPPGLPARPEARKVISANRARPRRAAN
Q91ZI0   SGLGEDSAPRAVRTAPTPGSAPRESRTAPG----RMRSRGLFRRRFLFERPGPRPPGFPTGPEAKQILSTNQARPRRAAN
O88278   SGLGEDSAPRAVRTAPAPGSAPHESRTAPE----RMRSRGLFRRGFLFERPGPRPPGFPTGAFAKRILSTNCARSRRAAN
Q9HCU4   --------------APRLRCQSCKLAQAPG---------------LRAGEPSP---------EESLG-GRRKRNVN
Q9R0M0   --------------APRLRCQSCKLAQAPG---------------LRAGEGSP---------EESLG-GRRKRNVN 330       340       350       360       370       380       390       400
         ....|....|....|....|....|....|....|....|....|....|....|....|....|....|....|....|
NOV2     RHPQFPQYNYQTLVPENEAAGTAVLRVVAQDPDAGEAGRLVYSLAALMNSRSLELFSIDPQSGLIRTAAALDRESMERHY
Q9NYQ7   RHPQFPQYNYQTLVPENEAAGTAVLRVVAQDPDAGEAGRLVYSLAALMNSRSLELFSIDPQSGLIRTAAALDRESMERHY
Q91ZI0   RHPQFPQYNYQTLVPENEAAGTSVLRVVAQDPDPGEAGRLVYSLAALMNSRSLELFSIDPQSGLIRTAAALDRESMERHY
O88278   RHPQFPQYNYQTLVPENEAAGTAVLRVVAQDPDAGEAGRLVYSLAALMNSRSLELFSIDPQSGLIRTAAALDRESMERHY
Q9HCU4   TAPQFQPPSYCATVPENQPAGTPVASLRAIDPDEGEAGRLEYTMDALFDSRSNQFFSLDPVIGAVYTABEELDREIKSTHV
Q9R0M0   TAPQFQPPSYCATVPENQPAGTSVASLRAIDPDEGEAGRLEYTMDALFDSRSNHFFSLDPILGVYTABEELDREIKSTEV 410       420       430       440       450       460       470       480
         ....|....|....|....|....|....|....|....|....|....|....|....|....|....|....|....|
NOV2     LRVTAQDHGSPRLSATTMVAVTVADRNDHSPVFEQAQYRETLRENVEEGYPILQLRATDGDAPPNANLRYRFVGPPAARA
Q9NYQ7   LRVTAQDHGSPRLSATTMVAVTVADRNDHSPVFEQAQYRETLRENVEEGYPILQLRATDGDAPPNANLRYRFVGPPAARA
Q91ZI0   LRVTAQDHGSPRLSATTMVAVTVADRNDHAPVFEQAQYRETLRENVEEGYPILQLRATDGDAPPNANLRYRFVGSPAVRT
O88278   LRVTAQDHGSPRLSATTMVAVTVADRNDHAPVFEQAQYRETLRENVEEGYPILQLRATDGDAPPNANLRYRFVGSPAART
```

```
Q9HCU4    FRVTAQDHGMPRRSALATYTILVIDTNDHDPVFEQQEYKESLRENLEVGYEVLTVRATDGDAPPNANILYRLLE--GSGG
Q9R0M0    FRVTAQDHGMPRRSALATYTILVIDTNDHDPVFEQQEYKESLRENLEVGYEVLTVRATDGDAPPNANILYRLLE--GAGD 490       500       510       520       530       540       550       560
                ....|....|....|....|....|....|....|....|....|....|....|....|....|....|....|....|
NOV2      AAAAAFEIDPRSGLISTSGRVDREHMESYELVVEASDQGQEPGPRSATVRVHITVLDENDNAPQFSEKRYVAQVREDVRP
Q9NYQ7    AAAAAFEIDPRSGLISTSGRVDREHMESYELVVEASDQGQEPGPRSATVRVHITVLDENDNAPQFSEKRYVAQVREDVRP
Q91ZI0    AAAAAFEIDPRSGLISTSGRVDREHMESYELVVEASDQGQEPGPRSATVRVHITVLDENDNAPQFSEKRYVAQVREDVRP
O88278    AAAAAFEIDPRSGLISTSGRVDREHMESYELVVEASDQGQEPGPRSATVRVHITVLDENDNAPQFSEKRYVAQVREDVRP
Q9HCU4    SPSEVFEIDPRSGVIRTRGPVDREEVESYQLTVEASDQGREPGPRSTIAAVFLSVEDDNDNAPQFSEKRYVVQVREDVTP
Q9R0M0    SPSDAFEIDPRSGVIRTRGPVDREEVESYKLTVEASDQGREPGPRSSTAIVFLSVEDDNDNAPQFSEKRYVVQVREDVTP 570       580       590       600       610       620       630       640
                ....|....|....|....|....|....|....|....|....|....|....|....|....|....|....|....|
NOV2      HTVVLRVTATDRDKDANGLVHYNIISGNSRGHFAIDSLTGEIQVVAPLDFEAEREYALRIRAQDAGRPPLSNNTGLASIQ
Q9NYQ7    HTVVLRVTATDRDKDANGLVHYNIISGNSRGHFAIDSLTGEIQVVAPLDFEAEREYALRIRAQDAGRPPLSNNTGLASIQ
Q91ZI0    HTVVLRVTATDKDKDANGLVHYNIISGNSRGHFAIDSLTGEIQVVAPLDFEAEREYALRIRAQDAGRPPLSNNTGLASIQ
O88278    HTVVLRVTATDKDKDANGLVHYNIISGNSRGHFAIDSLTGEIQVVAPLDFEAEREYALRIRAQDAGRPPLSNNTGLASIQ
Q9HCU4    GAPVLRVTASDRDKGSNAVHYSIMSGNARGQFYLDAQTGALDVVSPLDYETTKEYTLRVRAQDGGRPPLSNVSGLVTVC
Q9R0M0    GAPVLRVTASDRDKGSNALVHYSIMSGNARGQFYLDAQTGEALDVVSPLDYETTKEYTLRIRAQDGGRPPLSNVSGLVTVC 650       660       670       680       690       700       710       720
                ....|....|....|....|....|....|....|....|....|....|....|....|....|....|....|....|
NOV2      VVDINDH-IPIFVSTPFQVSVLENAPLGHSVIHIQAVDADHGENARLEYSLTGVAPDTPFVINSATGWVSVSGPLDRESV
Q9NYQ7    VVDINDH-IPIFVSTPFQVSVLENAPLGHSVIHIQAVDADHGENARLEYSLTGVAPDTPFVINSATGWVSVSGPLDRESV
Q91ZI0    VVDINDH-APIFVSTPFQVSVLENAPLGHSVIHIQAVDADHGENSRLEYSLTGVAPDTPFVINSATGWVSVSGPLDRESV
O88278    VVDINDH-SPIFVSTPFQVSVLENAPLGHSVIHIQAVDADHGENSRLEYSLTGVASDTPFVINSATGWVSVSGPLDRESV
Q9HCU4    VLDINDN-APIFVSTPFCATVLESVPLGYLVIHVQAITDADAGDNARLEYRLAGVGHDFPFTINNGTGWISVAAELDREEV
Q9R0M0    VLDINDIRPIFVSTPFCATVLESVPLGYLVIHVQAITDADAGDNARLEYSLAGVGHDFPFTINNGTGWISVAAELDREEV 730       740       750       760       770       780       790       800
                ....|....|....|....|....|....|....|....|....|....|....|....|....|....|....|....|
NOV2      EHYFFGVEARDHGSPPLSASASVTVTVLDVNDNRPEFTMKEYHLRLNEDAAVGTSVVSVTAVDRDANSAISYQITGGNTR
Q9NYQ7    EHYFFGVEARDHGSPPLSASASVTVTVLDVNDNRPEFTMKEYHLRLNEDAAVGTSVVSVTAVDRDANSAISYQITGGNTR
Q91ZI0    EHYFFGVEARDHGSPPLSASASVTVTVLDVNDNRPEFTMKEYHLRLNEDAAVGTSVVSVTAVDRDANSAISYQITGGNTR
O88278    EHYFFGVEARDHGSPPLSASASVTVTVLDVNDNRPEFTMKEYHLRLNEDAAVGTSVVSVTAVDRDANSAISYQITGGNTR
Q9HCU4    DFYSFGVEARDHGTPALTASASVTVILDVNDNNPTFTQPERYTVRLNEDAAVGTSVVTVSAVDRDAHSVIIYQITSGNTR
Q9R0M0    DFYSFGVEARDHGTPALTASASVTILDVNDNNETFTQPEYTVRLNEDAAVGTSVVTVSAVDRFAHSVITYQITSGNTR 810       820       830       840       850       860       870       880
                ....|....|....|....|....|....|....|....|....|....|....|....|....|....|....|....|
NOV2      NRFAISTQGGVGLVTLALPLDYKQERYFKLVLTASDRALHDHCYVHINITDANTHRPVFQSAHYSVSVNEDRPMGSTIVV
Q9NYQ7    NRFAISTQGGVGLVTLALPLDYKQERYFKLVLTASDRALHDHCYVHINITDANTHRPVFQSAHYSVSVNEDRPMGSTIVV
Q91ZI0    NRFAISTQGGVGLVTLALPLDYKQERYFKLVLTASDRALHDHCYVHINITDANTHRPVFQSAHYSVSVNEDRPVGSTVVV
O88278    NRFAISTQGGVGLVTLALPLDYKQERYFKLVLTASDRALHDHCYVHINITDANTHRPVFQSAHYSVSVNEDRPVGSTVVV
Q9HCU4    NRFSITSQSGGGLVSLALPLDYKLERQYVLAVTASDGTRQDTAQLVVNVTDANTHRPVFQSSHYIVNNEDRPAGTTVVL
Q9R0M0    NRFSITSQSGGGLSLALPLDYKLERQYVLAVTASDGTRQDTAQLVVNVTDANTHRPVFQSSHYIVNGNEDRPAGTTVVL 890       900       910       920       930       940       950       960
                ....|....|....|....|....|....|....|....|....|....|....|....|....|....|....|....|
NOV2      ISASDDDVGENARITYLLEDNLPQFRIDADSGAITLQAPLDYEDQVTYTLAITARDNGIPQKADTTYVEVMVNDVNDNAP
Q9NYQ7    ISASDDDVGENARITYLLEDNLPQFRIDADSGAITLQAPLDYEDQVTYTLAITARDNGIPQKADTTYVEVMVNDVNDNAP
Q91ZI0    ISASDDDVGENARITYLLEDNLPQFRIDADSGAITLQAPLDYEDQVTYTLAITARDNGIPQKADTTYVEVMVNDVNDNAP
O88278    ISASDDDVGENARITYLLEDNLPQFRIDADSGAITLQAPLDYEDQVTYTLAITARDNGIPQKADTTYVEVMVNDVNDNAP
Q9HCU4    ISADDEDTGENARITYFMEDSIPQFRIDADGAVTTQAELDYEDQVSYTLAITARDNGIPQKSDTTYLEITVNDVNDNAP
Q9R0M0    ISADDEDTGENARITYFMEDSIPQFRIDGDGAVTTQAELDYEDQVSYTLAITARDNGIPQKSDTTYLEITVNDVNDNAP 970       980       990       1000      1010      1020      1030      1040
                ....|....|....|....|....|....|....|....|....|....|....|....|....|....|....|....|
NOV2      QFVASHYTGLVSEDAPPFTSVLQISATDRDAHANGRVQYTFQNGEDGDGDFTIEPTSGIVRTVRRLDREAVSVYELTAYA
Q9NYQ7    QFVASHYTGLVSEDAPPFTSVLQISATDRDAHANGRVQYTFQNGEDGDGDFTIEPTSGIVRTVRRLDREAVSVYELTAYA
Q91ZI0    QFVASHYTGLVSEDAPPFTSVLQISATDRDAHANGRVQYTFQNGEDGDGDFTIEPTSGIVRTVRRLDREAVPVYELTAYA
O88278    QFVASHYTGLVSEDAPPFTSVLQISATDRDAHANGRVQYTFQNGEDGDGDFTIEPTSGIVRTVRRLDREAVPVYELTAYA
Q9HCU4    QFLRDSYQGSVYEDVPPFTSVLQISATDRDSGLNGRVFYTFQGGDGDGDFIVESTSGIVRTLRRLDRENVAQYVLRAYA
Q9R0M0    QFLRDSYQGSVVYEDVPPFTSVLQILATDRDSGLNGRVFYTFQGGEDGDGDFIVESTSGIVRTLRRLDRENVAQYVLRAYA 1050      1060      1070      1080      1090      1100      1110      1120
                ....|....|....|....|....|....|....|....|....|....|....|....|....|....|....|....|
NOV2      VDRGVPPLRTPVSIQVMVQDVNDNAPVFPAEEFEVRVKENSIVGSVVAQITAVDPDEGPNAHIMYQIVEGNIPELFQMDI
Q9NYQ7    VDRGVPPLRTPVSIQVMVQDVNDNAPVFPAEEFEVRVKENSIVGSVVAQITAVDPDEGPNAHIMYQIVEGNIPELFQMDI
Q91ZI0    VDRGVPPLRTPVSIQVMVQDVNDNAPVFPAEEFEVRVKENSIVGSVVAQITAVDPDEGPNAHIMYQIVEGNIPELFQMDI
O88278    VDRGVPPLRTPVSIQVTVQDVNDNAPVFPAEEFEVRVKENSIVGSVVAQITAVDPDDGPNAHIMYQIVEGNIPELFQMDI
Q9HCU4    VDKGMPPARTPMEVTVTVLDVNDNEPVFEQDEFDVFVEENSPIGLAVARVTATDPDEGTNAQIMYQIVEGNIPEVFQLDI
Q9R0M0    VDKGMPPARTPMEVTVTVLDGNDNEPVFEQDEFDVFVEENSPIGLAVARVTATDPDEGTNAQIMYQIVEGNIPEVFQLDI 1130      1140      1150      1160      1170      1180      1190      1200
                ....|....|....|....|....|....|....|....|....|....|....|....|....|....|....|....|
NOV2      FSGELTALIDLDYEARQEYVIVVQATSAPLVSRATVHVRLVDQNDNSPVLNNFQILFNNYVSNRSDTFPSGIIGRIPAYD
Q9NYQ7    FSGELTALIDLDYEARQEYVIVVQATSAPLVSRATVHVRLVDQNDNSPVLNNFQILFNNYVSNRSDTFPSGIIGRIPAYD
Q91ZI0    FSGELTALIDLDYEARQEYVIVVQATSAPLVSRATVHVRLVDQNDNSPVLNNFQILFNNYVSNRSDTFPSGIIGRIPAYD
O88278    FSGELTALIDLDYEARQEYVIVVQATSAPLVSRATVHVRLVDQNDNSPVLNNFQILFNNYVSNRSDTFPSGIIGRIPAYD
Q9HCU4    FSGELTALVDLDYEDRPEYVLVIQATSAPLVSRATVHVRLIDRNDNPPVLCNFEILFNNYVTNRSSSFPCGAIGRVPAHD
```

```
Q9R0M0  FSGELTALVDLDYEDRPEYVLVIQATSAPLVSRATVHVRLLDRNDNPPVLGNFEILFNNYVINRSSSFPGGAIGRVPAHD 1210       1220       1230       1240       1250       1260       1270       1280
             ....|....|....|....|....|....|....|....|....|....|....|....|....|....|....|....|
NOV2    PDVSDHLFYSFERGNELQLLVVNQTSGELRLSRKLDNNRPLVASMLVTVTDGLHSVTAQCVLRVVIITEELLANSLTVRL
Q9NYQ7   PDVSDHLFYSFERGNELQLLVVNQTSGELRLSRKLDNNRPLVASMLVTVTDGLHSVTAQCVLRVVIITEELLANSLTVRL
Q91ZI0   PDVSDHLFYSFERGNELQLLVVNQTSGELRLSRKLDNNRPLVASMLVTVTDGLHSVTAQCVLRVVIITEELLANSLTVRL
O88278   PDVSDHLFYSFERGNELQLLVVNQTSGELRLSRKLDNNRPLVASMLVTVTDGLHSVTAQCVLRVVIITEELLANSLTVRL
Q9HCU4   PDISDSLTYSFERGNELSLVLLNASTGELRLSRALDNNRPLEAIMSVLVSDGVHSVTAQCALRVIIITDEMLTESITLRL
Q9R0M0   PDISDSLTYSFERGNELSLVLLNASTGELRLSRALDNNRPLEAIMSVLVSDGVHSVTAQCSLRVIIITDEMLTESITLRL 1290       1300       1310       1320       1330       1340       1350       1360
             ....|....|....|....|....|....|....|....|....|....|....|....|....|....|....|....|
NOV2    ENMWQERFLSPLLGRFLEGVAAVLATPAEDVFIFNIQNDTDVGG-TVLNVSFSALAPRGAGAGAAGPWFSSEELQEQLYV
Q9NYQ7   ENMWQERFLSPLLGRFLEGVAAVLATPAEDVFIFNIQNDTDVGG-TVLNVSFSALAPRGAGAGAAGPWFSSEELQEQLYV
Q91ZI0   ENMWQERFLSPLLGHFLEGVAAVLATPTEDVFIFNIQNDTDVGG-TVLNVSFSALAPRGAGAGAAGPWFSSEELQEQLYV
O88278   ENMWQERFLSPLLGHFLEGVAAVLATPTEDVFIFNIQNDTDVGG-TVLNVSFSALAPRGAGAGAAGPWFSSEELQEQLYV
Q9HCU4   EDMSPERFLSPLLGLFIQAVAATLATPPDHVVFPNVQRDTDAPGGHILNVSLSVGQFPGPGGGP--PFLPSEDLQERLYL
Q9R0M0   EDMSPERFLSPLLGLFIQAVAATLATPPDHVVFPNVQRDTDAPGGHILNVSLSVGQFPGPGGGP--PFLPSEDLQERLYL 1370       1380       1390       1400       1410       1420       1430       1440
             ....|....|....|....|....|....|....|....|....|....|....|....|....|....|....|....|
NOV2    RRAALAARSLLDVLPFDDNVCLREPCENYMKCVSVLRFDSSAPFLASASTLFRPIQPIAGLRCRCPPGFTGDFCETELDL
Q9NYQ7   RRAALAARSLLDVLPFDDNVCLREPCENYMKCVSVLRFDSSAPFLASASTLFRPIQPIAGLRCRCPPGFTGDFCETELDL
Q91ZI0   RRAALAARSLLDVLPFDDNVCLREPCENYMKCVSVLRFDSSAPFLASASTLFRPIQPIAGLRCRCPPGFTGDFCETELDL
O88278   RRAALAARSLLDVLPFDDNVCLREPCENYMKCVSVLRFDSSAPFLASASTLFRPIQPIAGLRCRCPPGFTGDFCETELDL
Q9HCU4   NRSLLTAISAQRVLPFDDNICLREPCENYMRCVSVLRFDSSAPFIASSVLFRPIHPVGLRCRCPPGFTGDYCETEVDL
Q9R0M0   NRSLLTAISAKRVLPFDRQHLLREPCENYMRCVSVLRFDSSAPFIASSVLFRPIHLVGLRCRCPPGLTGDYCETEVDL 1450       1460       1470       1480       1490       1500       1510       1520
             ....|....|....|....|....|....|....|....|....|....|....|....|....|....|....|....|
NOV2    CYSNPCRNGGACARREGGYTCVCRPRFTGEDCELDTEAGRCVPGVCRNGGTCTDAPNGGFRCQCPAGGAFEGPRCEVAAR
Q9NYQ7   CYSNPCRNGGACARREGGYTCVCRPRFTGEDCELDTEAGRCVPGVCRNGGTCTDAPNGGFRCQCPAGGAFEGPRCEVAAR
Q91ZI0   CYSNPCRNGGACARREGGYTCVCRPRFT--DCELDTEAGRCVPGVCRNGGTCTDAPNGGFRCQCPAGGAFEGPRCEVAAR
O88278   CYSNPCRNGGACARREGGYTCVCRPRFTGEDCELDTEAGRCVPGVCRNGGTCTNAPNGGFRCQCPAGGAFEGPRCEVAAR
Q9HCU4   CYSRPCGPHGRCRSREGGYTCLCRDGYTGEHCEVSARSGRCTPGVCKNGGTCVNLLVGGFKCDCPSG-DFEKPYCQVTTR
Q9R0M0   CYSRTCGPHGRCRSREGGYTCLCRGCYTGEHCEASTHGRCTPGVCKNGGTCVNLLVGCIKCDCPSG-HFEKPFCQVTTR 1530       1540       1550       1560       1570       1580       1590       1600
             ....|....|....|....|....|....|....|....|....|....|....|....|....|....|....|....|
NOV2    SFPPSSFVMFRGLRQRFHLTLSLSFATVQQSGLLFYNGRLNEKHDFLALELVAGQVRLTYSTGESNTVVSPTVPGGLSDG
Q9NYQ7   SFPPSSFVMFRGLRQRFHLTLSLSFATVQQSGLLFYNGRLNEKHDFLALELVAGQVRLTYSTGESNTVVSPTVPGGLSDG
Q91ZI0   SFPPSSFVMFRGLRQRFHLTLSLSFATVQPSGLLFYNGRLNEKHDFLALELVAGQVRLTYSTGESNTVVSPTVPGGLSDG
O88278   SFPPSSFVMFRGLRQRFHLTLSLSFATVQPSGLLFYNGRLNEKHDFLALELVAGQVRLTYSTGESSTVVSPTVPGGLSDG
Q9HCU4   SFPAHSFTTFRGLRQRFHFTLALSFATKERDGLLLYNGRFNEKHDFVALEVTQBEQVQLTFSAGESTTITVSPFVPGGVSDG
Q9R0M0   SFPARPFTTFRGLHQRFHFTLALSFATKERNGLLLYNGRFNEKHDFVALEVTQBEQVQLTFSAGESTTITVSPFVPGGVSDG 1610       1620       1630       1640       1650       1660       1670       1680
             ....|....|....|....|....|....|....|....|....|....|....|....|....|....|....|....|
NOV2    QWHTVHLRYYNKPRTDALGGAQGPSKDKVAVLSVDDCDVAVALQFGAEIGNYSCAAAGVQTSSKKSLDLTGPLLLGGVPN
Q9NYQ7   QWHTVHLRYYNKPRTDALGGAQGPSKDKVAVLSVDDCDVAVALQFGAEIGNYSCAAAGVQTSSKKSLDLTGPLLLGGVPN
Q91ZI0   QWHTVHLRYYNKPRTDALGGAQGPSKDKVAVLSVDDCVVAVALQFGAEIGNYSCAAAGVQTSSKKSLDLTGPLLLGGVPN
O88278   QWHTVHLRYYNKPRTDALGGAQGPSKDKVAVLSVDDCNVAVALRFGAEIGNYSCAAAGVQTSSKKSLDLTGPLLLGGVPN
Q9HCU4   QWHTVQLKYYNKPLLGQTGLPQGPSEQKVAVVVDGCETGVALRFGSVLGNYSCAAQGTQGGSKKSLDLTGPLLLGGVPD
Q9R0M0   QWHTVQLKYYNKPLLGQTGLPQGPSRQKVAVVSVDGCETGVALRFGAMLGNYSCAAQGTQGGSKKSLDLTGPLLLGGVPD 1690       1700       1710       1720       1730       1740       1750       1760
             ....|....|....|....|....|....|....|....|....|....|....|....|....|....|....|....|
NOV2    LPENFPVSHKDFIGCMRDLHIDGRRVDMAAFVANNGTMAGCQAKLHFCDSGPCKNSGFCSERWGSFSCDCPVGFGGKDCS
Q9NYQ7   LPENFPVSHKDFIGCMRDLHIDGRRVDMAAFVANNGTMAGCQAKLHFCDSGPCKNSGFCSERWGSFSCDCPVGFGGKDCQ
Q91ZI0   LPENFPVSHKDFIGCMRDLHIDGRRVDMAAFVANNGTIAGCQAKSHFCASGPCKNNGFCSERWGCFSCDCPVGFGGKDCR
O88278   LPENFPVSRKDFIGCMRDLHIDGRRVDMAAFVANNGTIAGCQAKSHFCASGPCKNGGLCSERWGCFSCDCPVGFGGKDCR
Q9HCU4   LPESFPVRMRQHVGCMRNLQVDSRHIDMADFIANNGTVPGCPAKKNVCDSNTCHNGGTGVNQWDAFSCECPLGFGGKSCA
Q9R0M0   LPESFPVRMKHFVGCMKDLQVDSRHIDMADFIANNGTVPGCPTKKIVCDSSICHNGGTCVNQNNTFSCECPLGFGGKSCA 1770       1780       1790       1800       1810       1820       1830       1840
             ....|....|....|....|....|....|....|....|....|....|....|....|....|....|....|....|
NOV2    LTMAHPHHFRGNGTLSWNFGSDMAVSVPWYLGLFRTRATQGVLMQVCAGPHSTLLCQLDRGLLSVTVTRGSGRASHLLI
Q9NYQ7   LTMAHPHHFRGNGTLSWNFGSDMAVSVPWYLGLFRTRATQGVLMQVCAGPHSTLLCQLDRGLLSVTVIRGSGRASHLLI
Q91ZI0   LTMAHPYHFQGNGTLSWDFGNDMAVSVPWYLGLSFRTRATKGILMQVCLGPHSVLLCKLDRGLLSVTLNRASGHTVHLLL
O88278   LTMAHPHHFQGNGTLSWNDMPVSVPWYLGLSFRTRATKGVHLQVCLLCKDGLLSVTLSRASGHAVHLLL
Q9HCU4   QEMANEQHFLGSSLVAW-HGLSLPISQPWYLSLMFRTRQADGVLLCAITRGRSTITLQLRAGHVMLSVEGTGLQASSLRL
Q9R0M0   QEMANFQRFLGSSLVAW-HGLYLPISQPWHLNLMFRTRQADGVLLCAVTRGRSTITLQLRAGHVRLSMEGTGLQASSLHL 1850       1860       1870       1880       1890       1900       1910       1920
             ....|....|....|....|....|....|....|....|....|....|....|....|....|....|....|....|
NOV2    DQVTVSDGRWHDLRLELQEEPGGRRGHHVLMVSLDFSLFQDTMAVGSELQGLKVKQLHVGGLPPGSAEEAPQGLVGCIQG
Q9NYQ7   DQVTVSDGRWHDLRLELQEEPGGRRGHHVLMVSLDFSLFQDTMAVGSELQGLKVKQLHVGGLPPGSAEEAPQGLVGCIQG
Q91ZI0   DQVTVSDGRWHDLRLELQEEPGGRRGHHIFMVSLDFTLFQDTMAVGGBLQGLKVKQLHVGGLPPSSKEEGHQGLVGCIQG
O88278   DQVTVSDGRWHDLRLELQEEPGGRRGHHIFMVSLDFTLFQDTMAMGSELEGLKVVHLHVGGLPPSSKEEGPQGLVGCIQG
Q9HCU4   EPGRANDGDWHAQLAL----GASGGPGHAILSFDYGQQKAEGNLGPRLHGLHLSNITVGGIP-GPAGGVARGFRGCLQG
Q9R0M0   EPGRANDGDWHAQLAL----GASRGPGHAILSFNYGQQTAEGNLGPRLHGLHLSNITVGGVP-GPASGVARGFRGCLQG
```

```
              1930      1940      1950      1960      1970      1980      1990      2000
              ....|....|....|....|....|....|....|....|....|....|....|....|....|....|....|
NOV2    VWLGSTPSGSPALLPP-SHRVNAEPGCVVTNACASGPCPPHADCRDLWQTFSCTCQPGYYGPGCVDACLLNPCQNQGSCR
Q9NYQ7  VWLGSTPSGSPALLPP-SHRVNAEPGCVVTNACASGPCPPHADCRDLWQTFSCTCQPGYYGPGCVDACLLNPCQNQGSCR
Q91ZI0  VWLGFTPGGSSALLPP-SHRVNVEPGCIVTNPCASGPCPPHADCRDLWQTFSCTCQPGYYGPGCVDACLLNPCQNQGSCR
O88278  VRLGFTPEGSSALLPP-SHRINVEPGCIVTNPCASGPCPPHANCRDLWQTFSCTCWPGYYGPGCVDACLLNPCQNQGSCR
Q9HCU4  RKVSDTPEGVNSLDPSHGESINVEGCSLPDPCDSNPCEANSYCSNDWDSYSCSCQPGYYGDNCTNVCDLNPCEHCSVCT
Q9R0M0  VRVSETPEGVHSLDPSRGESINVEPGCSLPDPCDSNPCFTNSYYSNDWNSYSCSCVLGYYGDNCTNVCDLNPCEHCSVCT 2010      2020      2030      2040      2050      2060      2070      2080
              ....|....|....|....|....|....|....|....|....|....|....|....|....|....|....|
NOV2    HLPGAPHGYTCDCVCGYFGHHCEHRMDQQCCPRGWWGSPTCGPCNCDVHKGFDPNCNKTNGQCHCKEFHYRPRGSDSCLPC
Q9NYQ7  HLPGAPHGYTCDCVCGYFGHHCEHRMDQQCCPRGWWGSPTCGPCNCDVHKGFDPNCNKTNGQCHCKEFHYRPRGSDSCLPC
Q91ZI0  HLQGAPHGYTCDCVSGYFGQHCEHRMDQQCCPRGWWGSPTCGPCNCDVHKGFDPNCNKTNGQCHCKEFHYRPRGSDSCLPC
O88278  HLQGPPHGYTCDGASGYFGHCEHRMDQQCCPRGWWGSPTCGPCNCDVHKGFDPNCNKTSGQCHCKEFHYRPRGSDSCLPC
Q9HCU4  RKFSAPHGYTCECPPNYLGPYCETRIDCPECPRGWWGHPTCGPCNCDVSKGFDPDCNKTSGECHCKENHYRPGSPTCLLC
Q9R0M0  RKENTPHGYICECPNYLGPYCETRIDCPECPRGWWGHPTCGPCNCDVSKGFDPDCNKTSGECHCKEKHYRPGSPTCLLC 2090      2100      2110      2120      2130      2140      2150      2160
              ....|....|....|....|....|....|....|....|....|....|....|....|....|....|....|
NOV2    DCYPVGSTSRSCAPHSGQCPCRPGALGRQCNSCDSPFAEVTASGCRVLYDACPKSLRSGVWWPQTKFGVLATVPCPRGAL
Q9NYQ7  DCYPVGSTSRSCAPHSGQCPCRPGALGRQCNSCDSPFAEVTASGCRVLYDACPKSLRSGVWWPQTKFGVLATVPCPRGAL
Q91ZI0  DCYPVGSTSRSCAPHSGQCPCRPGALGRQCNSCDSPFAEVTASGCRVLYDACPKSLRSGVWWPQTKFGVLATVPCPRGAL
O88278  DCYPVGSTSRSCAPHSGQCPCRPGALGRQCNSCDSPFAEVTASGCRVLYDACPKSLRSGVWWPQTKFGVLATVPCPRGAL
Q9HCU4  DCYPTGSLSRVCDEDGQCPCKPGVIGRQCDRCDNPFAEVTTNGCEVNYDSCPRATEAGIWWPRTRFGLPAAAPCPKGSF
Q9R0M0  DCYPTGSLSRVCDEDGQCPCKPGVIGRQCDRCDNPFAEVTTNGCEVNYDSCPRATEAGIWWPRTRFGLPAAAPCPKGSF 2170      2180      2190      2200      2210      2220      2230      2240
              ....|....|....|....|....|....|....|....|....|....|....|....|....|....|....|
NOV2    G-----AAVRLCDEADGWLEPDLFNCTSPAFRELSLLLDGLELNKTALDTVEAKKLAQRLREVTGHTDHYFSQDVRVTAR
Q9NYQ7  G-----AAVRLCDEADGWLEPDLFNCTSPAFRELSLLLDGLELNKTALDTVEAKKLAQRLREVTGHTDHYFSQDVRVTAR
Q91ZI0  -----GAAVRLCDEDGWLEPDLFNCTSPAFRELSLLLDGLELNKTALDTVEAKKLAQRLREVTGQTDHYFSQDVRVTAR
O88278  GLRGTGAAVRLCDEDHGWLEPDLFNCTSPAFRELSLLLDGLELNKTALDTVEAKKLAQRLREVTGQTDHYFSQDVRVTAR
Q9HCU4  G-----TAVRHCDEHRGWLPPNLFNCTSITFSELKGFAERLQRNESGLDSGRSQQLALLLRNATHTAGYFGSDVKVAYQ
Q9R0M0  G-----TAVRHCDEHRGWLPPNLFNCTSVTFSELKGFAERLQRNESGLDSGRSQRLALLLRNATQHTSGYFGSDVKVAYQ 2250      2260      2270      2280      2290      2300      2310      2320
              ....|....|....|....|....|....|....|....|....|....|....|....|....|....|....|
NOV2    LLAELLAFESHQQGFGLTATQDAHFNENLLWAGSALLAPETGDLWAALGQRAPGGSPGSAGLVRHLEEYAATLARNMELT
Q9NYQ7  LLAELLAFESHQQGFGLTATQDAHFNENLLWAGSALLAPETGDLWAALGQRAPGGSPGSAGLVRHLEEYAATLARNMELT
Q91ZI0  LLAELLAFESHQQGFGLTATQDAHFNENLLWAGSALLAPETGHLWAALGQRAPGGSPGSAGLVQHLEEYAATLARNMELT
O88278  LLAYLLAFESHQQGFGLTATQDAHFNENLLWAGSALLAPETGDLWAALGQRAPGGSPGSAGLVRHLEEYAATLARNMDLT
Q9HCU4  LATRLLAHESTCRGFGLSATQDVHFTENLLRVGSALLDTANKRHWELTQQTEG----GTAWLLQHYEAYASALAQNMRHT
Q9R0M0  LATRLLAHESAQRGFGLSATQDVHFTENLLRVGSALLDAANKRHWELTQQTEG----GTAWLLQHYEAYASALAQNMRHT 2330      2340      2350      2360      2370      2380      2390      2400
              ....|....|....|....|....|....|....|....|....|....|....|....|....|....|....|
NOV2    YLNPVGLVTPNIMLSIDRMEHPSSPRGARRYPRYHSNLFRGQDAWDPHTHVLLPSQSPRPSPSEVLPTSSSIENSTTSSV
Q9NYQ7  YLNPVGLVTPNIMLSIDRMEHPSSPRGARRYPRYHSNLFRGQDAWDPHTHVLLPSQSPRPSPSEVLPTSSSIENSTTSSV
Q91ZI0  YLNPVGLVTPNIMLSIDRMEHPSSTQGARRYPRYHSNLFRGQDAWDPHTHVLLPSQSPTPSPSEVLPTSSNAENATASSV
O88278  YLNPVGLVTPNIMLSIDRMEQPSSSCGAHRYPRYHSNLFRGQDAWDPHTHVLLPSQSPQPSPSEVLPTSSNAENATASGV
Q9HCU4  YLSPFTIVTPNIVISVVRLDK--GNFAGAKLPRYEA--LRGEQPPDLETIVILPESVFREIFPVVRPAGPGEAQEPEELA
Q9R0M0  YLSPFTIVTPNIVISVVRLDK--GNFAGTKLPRYEA--LRGERPPDVETIVILPESVFREMPSMVRSAGPGEAQETEELA 2410      2420      2430      2440      2450      2460      2470      2480
              ....|....|....|....|....|....|....|....|....|....|....|....|....|....|....|
NOV2    VPPPAPPEPE--PGISITILLVYRTLGGLLPAQFQAERRGARLPQNPVMNSPVVSVAVFHGRNFLRGILESPISLEFRLL
Q9NYQ7  VPPPAPPEPE--PGISITILLVYRTLGGLLPAQFQAERRGARLPQNPVMNSPVVSVAVFHGRNFLRGILESPISLEFRLL
Q91ZI0  VSPPAPLEPESEPGISIVILLVYRALGGLLPAQFQAERRGARLPQNPVMNSPVVSVAVFHGRNFLRGVLVSPINLEFRLL
O88278  VSPPAPLEPESEPGISIVILLVYRALGGLLPAQFQAERRGARLPQNPVMNSPVVSVAVFHGRNFLRGALVSPINLEFRLL
Q9HCU4  RRQRRHPELS--QGEAVASVLIYRTLAGLLPHNYDPDKRSLRVPKRPLINIPVVSISVHDDEELLPRALDKPVTVCFRLL
Q9R0M0  RRQRRHPELS--QGEAVASVIIYHTLAGLLPHNYDPDKRSLRVPKRPVINTPAVSISVHDDEELLPRALDKPVTVCFRLL 2490      2500      2510      2520      2530      2540      2550      2560
              ....|....|....|....|....|....|....|....|....|....|....|....|....|....|....|
NOV2    QTANRSKAICVQWDPPGLAEQHGVWTARDCELVHRNGSHARCRCSRTGTFGVLMDASPRERLEGDLELLAVFTHVVVAVS
Q9NYQ7  QTANRSKAICVQWDPPGLAEQHGVWTARDCELVHRNGSHARCRCSRTGTFGVLMDASPRERLEGDLELLAVFTHVVVAVS
Q91ZI0  QTANRSKAICVQWDPPGPTEQHGVWTARDCELVHRNGSHARCRCSRTGTFGVLMDASPRERLEGDLELLAVFTHVVVAVS
O88278  QTANRSKAICVQWDPPGPADQHGVWTARDCELVHRNGSHARCRCSRTGTFGVLMDASPRERLEGDLELLAVFTHVVVAAS
Q9HCU4  ETEERTKPICVFTNHSILVSGTGGNSARGCEVVRNESHVSCQCNHMTSFAVLMDVSRRE--NGEILPLKTLTYVALGVL
Q9R0M0  ETEERTKPICVFTNHSILVSGTGGNSARGCEVVRNESHVSCQCNHMTSFAVLMDVSRRE--NGEILPLKTLTYVALGVL 2570      2580      2590      2600      2610      2620      2630      2640
              ....|....|....|....|....|....|....|....|....|....|....|....|....|....|....|
NOV2    VAALVLTAAILLSLRSLKSNVRGIHANVAAALGVAELLFLLGIHRTHNQVQDQGQGTCVLMTLLAQEAWGQNSGSELVCT
Q9NYQ7  VAALVLTAAILLSLRSLKSNVRGIHANVAAALGVAELLFLLGIHRTHN---------------------------QLVCT
Q91ZI0  VTALVLTAVLLSLRSLKSNVRGIHANVAAALGVAELLFLLGIHRTHN---------------------------QLLCT
O88278  VTALVLTAVLLSLRSLKSNVRGIHANVAAALGVAELLFLLGIHRTHN---------------------------QLLCT
Q9HCU4  AALLLTFFFLTLLRILRSNQHGIRRNLTAALGLAQLVFLLGINQADLP---------------------------FACT
Q9R0M0  AALLMLTFLFLTLLRALRSNQHGIRRNLTAALGLAQLVFLLGINQADLP---------------------------FACT
```

```
              2650      2660      2670      2680      2690      2700      2710      2720
              ....|....|....|....|....|....|....|....|....|....|....|....|....|....|....|
NOV2     AVAILLHYFFLSTFAWLVVQGLHLYRMQVEPRNVDRGAMRFYHALGWGVPAVLLGLAVGLDPEGYGNPDFCWISVHEPLI
Q9NYQ7   AVAILLHYFFLSTFAWLVVQGLHLYRMQVEPRNVDRGAMRFYHALGWGVPAVLLGLAVGLDPEGYGNPDFCWISVHEPLI
Q91ZI0   AVAILLHYFFLSTFAWLLVQGLHLYRMQVEPRNVDRGAMRFYHALGWGVPAVLLGLAVGLDPEGYGNPDFCWISHEPLI
O88278   VVAILLHYFFLSTFAWLLVQGLHLYRMQVEPRNVDRGAMRFYHALGWGVPAVLLGLAVGLDPEGYGNPDFCWISHEPLI
Q9HCU4   VIAILLHFLYLCTFSWALLEALHLYRALTEVRDVNTGPMRFYYMGWGVPAFITGLAVGLDPEGYGNPDFCWLSYDTLI
Q9R0M0   VIAILLHFLYLCTFSWALLEALHLYRALTEVRDVNASPMRFYYMGWGVPAFITGLAVGLDPEGYGNPDFCWLSVYDTLI 2730      2740      2750      2760      2770      2780      2790      2800
              ....|....|....|....|....|....|....|....|....|....|....|....|....|....|....|
NOV2     WSFAGPVVLVIVMNGTMFLLAARTSCSTGQREAKKTSALRTLRSSFLLLLLVSASWLFGLLAVNHSILAFHYLHAGLCGL
Q9NYQ7   WSFAGPVVLVIVMNGTMFLLAARTSCSTGQREAKKTSAL-TLRSSFLLLLLVSASWLFGLLAVNHSILAFHYLHAGLCGL
Q91ZI0   WSFAGPIVLVIVMNGTMFLLAARTSCSTGQREAKTSVL-TLRSSFLLLLLVSASWLFGLLAVNHSILAFHYLHAGLCGL
O88278   WSFAGPIVLVIVMNGIMFLLAARTSCSTGQREAKKTSVLRTLRSSFLLLLLVSASWLFGLLAVNHSVLAFHYLHAGLCGL
Q9HCU4   WSFAGPVAFAVSMSVFLYILLAARASCAAQROGFEKGPVSGLQPSFAVLLLISAIWLALLSVNSDTLLFHYLFATCNCI
Q9R0M0   WSFAGPVAFAVSMRVFLYILSARASCAAQROGFEKGPVSGLRSSFTVLLLISAIWLALLSVNSDTLLFHYLFAACNCV 2810      2820      2830      2840      2850      2860      2870      2880
              ....|....|....|....|....|....|....|....|....|....|....|....|....|....|....|
NOV2     QGLAVLLLFCVLNADARAAWMPACLGRKAAPEEARPAPGLGPGAYNNTALFEESGLIRITLGASTVSSVSSARSGRIQDC
Q9NYQ7   QGLAVLLLFCVLNADARAAWMPACLGRKAAPEEARPAPGLGPGAYNNTALFEESGLIRITLGASTVSSVSSARSGRIQDC
Q91ZI0   QGLAVLLLFCVLNADARAAWTPACLGKKAAPEFTRPAPGPGSGAYNNTALFEESGLIRITLGASTVSSVSSARSGRAQDC
O88278   QGLAVLLLFCVLNADARAAWTPACLGKKAAPEEIRPAPGPGSGAYNNTALFEESGLIRITLGASTVSSVSSARSGRAQDC
Q9HCU4   QGPFFLSIVVLSKEVRKALKLACS-RKPSPDPALTTKSTLTSSYNCPSPYAD-GRLYQPYGDSAGSLHSTSRSGKSCP-
Q9R0M0   QGPFFLSIVVLSKEVRKALKFACS-RKPSPDPALTTKYTLTSSYNCPSPYAD-GRLYQPYGDSAGSLHSASRSGKSCP- 2890      2900      2910      2920      2930      2940      2950      2960
              ....|....|....|....|....|....|....|....|....|....|....|....|....|....|....|
NOV2     DSQRGRSYLRDNVLVRHGSAADHTDHSLQAHAGPTDLDVAMFHRDAGADSDSDSDLSLEEERSLSIPSSESEDNGRTRGR
Q9NYQ7   DSQRGRSYLRDNVLVRHGSAADHTDHSLQAHAGPTDLDVAMFHRDAGADSDSDSDLSLEEERSLSIPSSESEDNGRTRGR
Q91ZI0   DSQRGRSYLRDNVLVRHGSTAEHTRSLQAHAGPTDLDVAMFHRDAGADSDSDSDLSLEEERSLSIPSSESEDNGRTRGR
O88278   DSQRGRSYLRDNVLVRHGSTAEHAHSLQAHAGPTDLDVAMFHRDAGADSDSDSDLSLEEERSLSIPSSESEDNGRTRGR
Q9HCU4   ------SYIP--FLLRE-ESALNPGQGPPGLGDFGSLFLEGQDQQHDPDIDSDSDLSLEDDCSGSYASTHSSDSEEEEE
Q9R0M0   ------SYIP--FLLRE-ESTLNPGQVPPGLGDSGLFLEGQAQHDPDFDSDSDLSLEDDCSGSYASTHSSDSEEEEE- 2970      2980      2990      3000      3010      3020      3030      3040
              ....|....|....|....|....|....|....|....|....|....|....|....|....|....|....|
NOV2     FQRPLCRAAQSERLLTHPKDVDGNDLLSYWPALGECEAAPCALQTWGSERRLGLDTSKDAANNNQPDPALTSGDETSLGR
Q9NYQ7   FQRPICRAAQSERLLTHPKDVDGNDLLSYWPALGECEAAPCALQTWGSERRLGLDTSKDAANNNQPDPALTSGDETSLGR
Q91ZI0   FQRPLRRAAQSERLLAHPKDVDGNDLLSYWPALGECEAAPCALQAWGSERRLGLDSNKDAANNNQPEPALTSGDETSLGR
O88278   FQRPLRRAAQSERLLAHPKDVDGNDLLSYWPALGECEAAPCALQAWGSERRLGLDSNKDAANNNQPELALTSGDETSLGR
Q9HCU4   EEE-----------------------EAAFPGEQGWDS--LLGPGAERLPLHSTPKEGGPGPGKAPWPG-
Q9R0M0   ------------------------EAAFPGEQGWDS--CLGPGAERLPLHSTPKEGGPGSGKVPWLG- 3050      3060      3070      3080      3090      3100      3110      3120
              ....|....|....|....|....|....|....|....|....|....|....|....|....|....|....|
NOV2     AQRQRKGILKNRLQYPLVPQTRGAPELSWCRAATLGHRAVPAASYGRIYAGGGTGSLSQPASRYSSREQLDLLLRRQLSR
Q9NYQ7   AQRQRKGILKNRLQYPLVPQTRGAPELSWCRAATLGHRAVPAASYGRIYAGGGTGSLSQPASRYSSREQLDLLLRRQLSR
Q91ZI0   AQRQRKGILKNRLQYPLVPQSRGTPELSWCRAATLGHRAVPAASYGRIYAGGGTGSLSQPASRYSSREQLDLLLRRQLSR
O88278   AQRQRKGILKNRLQYPLVPQTRGTPELSWCRAATLGHRAVPAASYGRIYAGGGTGSLSQPASRYSSREQLDLLLRRQLSR
Q9HCU4   ----------------DFGTTAK----------------------ESSGNGAPEE-----RLRENGDALSR-----
Q9R0M0   ----------------DFGTTTK----------------------ENSGSGALEE-----RPRENGDALTR-----

3130      3140      3150      3160      3170      3180      3190      3200
              ....|....|....|....|....|....|....|....|....|....|....|....|....|....|....|
NOV2     ERLEEA--PAPVLRPLSRPGSQECMDAAPGRLEPKDRGSTLPRRQPPRDYPGAMAGRFGSRDALDLGAPREWLSTLPPPR
Q9NYQ7   ERLEEA--PAPVLRPLSRPGSQECMDAAPGRLEPKDRGSTLPRRQPPRDYPGAMAGRFGSRDALDLGAPREWLSTLPPPR
Q91ZI0   ERLEEVPVPAPVLHPLSRPGSQERLDTAPARLEARDRGSTLPRRQPPRDYPGIMAGRFGSRDALDLGAPREWLSTLPPPR
O88278   ERLEEVPVPAPVLHPLSRPGSQERLDTAPARLEPRDRGSTLPRRQPPRDYPGIMAGRFGSRDALDLGAPREWLSTLPPPR
Q9HCU4   ----EGS-----LGPLPGSSACPHKGILKKKCLPTISEKSSLLRLELEQCTGSSRC------SSASECGRGG-----PPPR
Q9R0M0   ----EGS-----LGPLPGESTCPHKGILKKKCLPTISEKSSLLRLELEQCTGSSRC------SSISECGSRHG-----PPPR 3210      3220      3230      3240      3250      3260      3270      3280
              ....|....|....|....|....|....|....|....|....|....|....|....|....|....|....|
NOV2     RTRDLDPCPPPLPLPSPQRQLSRDPLLPSRPLDSLSRSSNSREQLDQVPSRHPSREALGPCPQLLRAREDSVSGPSHGPST
Q9NYQ7   RTRDLDPCPPPLPLPSPQRQLSRDPLLPSRPLDSLSRSSNSREQLDQVPSRHPSREALGPCPQLLRAREDSVSGPSHGPST
Q91ZI0   RNRDLDPCHPPLPLPSPQRQLSRDPLLPSRPLDSLSRISNSREGLDQVPSRHPSREALGPAPQLLRAREDPASGPSHGPST
O88278   RNRDLDPCHPPLPLPSPQRPLSRDPLLPSRPLDSLSRISNSRERLDQVPSRHPSREALGPAPQLLRAREDPASGPSHGPST
Q9HCU4   --------PPPRQSLCEQLN---------------------------GVMEIAMSIKAGTVDEDSSGSEF
Q9R0M0   --------PPPRQSLCEQLN---------------------------GVMEVAMSINAGTVDEDSSGSEF 3290      3300      3310      3320      3330      3340      3350      3360
              ....|....|....|....|....|....|....|....|....|....|....|....|....|....|....|
NOV2     EQLDILSSILASFNSSALSSVQSSSTPLGPHTTATPSATASVLGPSTPRSATSHSISELSPDSEPRDTQALLSATQAMDL
Q9NYQ7   EQLDILSSILASFNSSALSSVQSSSTPLGPHTTAT----ASALGPSTPRSATSHSISELSPDSE-------------VPR
Q91ZI0   EQLDILSSILASFNSSALSSVQSSSTPLGPHTTAT----ASALGPSTPRSATSHSISELSPDSE-------------VPR
O88278   EQLDILSSILASFNSSALSSVQSSSTPSGPHTTATPSATASALGPSTPRSATSHSISELSPDSE-------------VPR
Q9HCU4   LFFNPLH------------------------------------------------------------------
Q9R0M0   LFFNPLH------------------------------------------------------------------

3370      3380      3390      3400      3410      3420      3430      3440
```

```
NOV2    RRRDYHMERPLLNQEHLEELGRWGSAPRTHQWRTWLQCSRARAYALLLQHLPVLVWLPRYPVRDWLLGDLLSGLSVAIMQ
Q9NYQ7  SEGHS---------------------------------------------------------------------------
Q91ZI0  SEGHS---------------------------------------------------------------------------
O88278  SEGHS---------------------------------------------------------------------------
Q9HCU4  --------------------------------------------------------------------------------
Q9R0M0  --------------------------------------------------------------------------------

3450      3460      3470      3480      3490      3500      3510      3520
         ....|....|....|....|....|....|....|....|....|....|....|....|....|....|....|....|
NOV2    LPQGLAYALLAGLPPVFGLYSSFYPVFIYFLFGTSRHISVESLCVPGPVDTGTFAVMSVMVGSVTESLAPQALNDSMINE
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

3530      3540      3550      3560      3570      3580      3590      3600
         ....|....|....|....|....|....|....|....|....|....|....|....|....|....|....|....|
NOV2    TARDAARVQVASTLSVLVGLFQVGLGLIHFGFVVTYLSEPLVRGYTTAAAVQVFVSQLKYVFGLHLSSHSGPLSLIYTVL
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

3610      3620      3630      3640      3650      3660      3670      3680
         ....|....|....|....|....|....|....|....|....|....|....|....|....|....|....|....|
NOV2    EVCWKLPQSKVGTVVTAAVAGVVLVVVKLLNDKLQQQLPMPIPGELLTLIGATGISYGMGLKHRFEVDVVGNIPAGLVPP
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

3690      3700      3710      3720      3730      3740      3750      3760
         ....|....|....|....|....|....|....|....|....|....|....|....|....|....|....|....|
NOV2    VAPNTQLFSKLVGSAFTIAVVGFAIAISLGKIFALRHGYRVDSNQELVALGLSNLIGGIFQCFPVSCSMSRSLVQESTGG
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

3770      3780      3790      3800      3810      3820      3830      3840
         ....|....|....|....|....|....|....|....|....|....|....|....|....|....|....|....|
NOV2    NSQVAGAISSLFILLIIVKLGELFHDLPKAVLAAIIIVNLKGMLRQLSDMRSLWKANRADLLIWLVTFTATILLNLDLGL
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

3850      3860      3870      3880      3890      3900      3910      3920
         ....|....|....|....|....|....|....|....|....|....|....|....|....|....|....|....|
NOV2    VVAVIFSLLLVVVRTQMPHYSVLGQVPDTDIYRDVAEYSEAKEVRGVKVFRSSATVYFANAEFYSDALKQRCGVDVDFLI
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

3930      3940      3950      3960      3970      3980      3990      4000
         ....|....|....|....|....|....|....|....|....|....|....|....|....|....|....|....|
NOV2    SQKKKLLKKQEQLKLKQLQKEEKLRKQAGPLLSACLAPQQVSSGDKMEDATANGQEDSKAPDGSTLKALGLPQPDFHSLI
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

4010      4020      4030      4040      4050      4060      4070      4080
         ....|....|....|....|....|....|....|....|....|....|....|....|....|....|....|....|
NOV2    LDLGALSFVDTVCLKSLKNIFHDFREIEVEVYMAACHSPVVSQLEAGHFFDASITKKHLFASVHDAVTFALQHPRPVPDS
Q9NYQ7  --------------------------------------------------------------------------------
Q91ZI0  --------------------------------------------------------------------------------
O88278  --------------------------------------------------------------------------------
Q9HCU4  --------------------------------------------------------------------------------
Q9R0M0  --------------------------------------------------------------------------------

4090      4100      4110      4120
         ....|....|....|....|....|....|....|....|...|
```

| | |
|---|---|
| NOV2 | PVSPSLAVSSDVKQLEPELLLRNNLLSGIPEKVQGSVGANGQSLEDTE |
| Q9NYQ7 | ----------------------------------------------- |
| Q91ZI0 | ----------------------------------------------- |
| O88278 | ----------------------------------------------- |
| Q9HCU4 | ----------------------------------------------- |
| Q9R0M0 | ----------------------------------------------- |

BLAST analysis was performed on sequences from the Patp database, which is a proprietary database that contains sequences published in patents and patent publications. Patp results include those listed in Table 2E.

TABLE 2E

Patp BLASTP Analysis for NOV2

| Sequences producing High-scoring Segment Pairs | Protein/Organism | Length (aa) | Identity (%) | Positive (%) | E Value |
|---|---|---|---|---|---|
| patp: AAE03657 | Human extracellular matrix and cell adhesion molecule-21 (XMAD-21) - *Homo sapiens* | 3298 | 2421/2618 (92%) | 2450/2618 (93%) | 0.0 |
| patp: AAU07054 | Human Flamingo protein encoded by cDNA splice variant - *Homo sapiens* | 2923 | 1345/2330 (57%) | 1681/2330 (72%) | 0.0 |
| patp: AAU07053 | Human Flamingo polypeptide - *Homo sapiens* | 2956 | 1345/2330 (57%) | 1681/2330 (72%) | 0.0 |
| patp: AAE08586 | Human NOV7 protein - *Homo sapiens* | 3028 | 1192/2237 (53%) | 1551/2237 (69%) | 0.0 |
| patp: AAB42192 | Human ORFX ORF1956 polypeptide sequence SEQ ID NO: 3912 - *Homo sapiens* | 2405 | 1046/1687 (62%) | 1284/1687 (76%) | 0.0 |

Table 2F lists the domain description from DOMAIN analysis results against NOV2.

| Table 2F. Domain Analysis of NOV2 ||||||||
|---|---|---|---|---|---|---|---|
| Model | Domain | seq-f | seq-t | hmm-f | hmm-t | score | E-value |
| cadherin | 1/9 | 329 | 423 .. | 1 | 107 [] | 89.9 | 5e-23 |
| cadherin | 2/9 | 437 | 535 .. | 1 | 107 [] | 94.9 | 1.6e-24 |
| cadherin | 3/9 | 549 | 641 .. | 1 | 107 [] | 107.4 | 2.7e-28 |
| cadherin | 4/9 | 655 | 746 .. | 1 | 107 [] | 103.9 | 3.2e-27 |
| cadherin | 5/9 | 760 | 848 .. | 1 | 107 [] | 76.9 | 4.3e-19 |
| cadherin | 6/9 | 862 | 951 .. | 1 | 107 [] | 80.0 | 4.7e-20 |
| cadherin | 7/9 | 965 | 1057 .. | 1 | 107 [] | 99.7 | 5.8e-26 |
| cadherin | 8/9 | 1071 | 1159 .. | 1 | 107 [] | 87.4 | 2.8e-22 |
| EGF | 2/6 | 1438 | 1469 .. | 1 | 45 [] | 33.3 | 5.6e-06 |
| EGF | 3/6 | 1478 | 1512 .. | 1 | 45 [] | 35.8 | 9.8e-07 |
| laminin_G | 1/3 | 1542 | 1606 .. | 1 | 77 [. | 56.1 | 8.2e-15 |
| EGF | 4/6 | 1725 | 1756 .. | 1 | 45 [] | 40.4 | 4.1e-08 |
| laminin_G | 3/3 | 1792 | 1926 .. | 1 | 161 [] | 30.4 | 1.9e-07 |
| EGF | 5/6 | 1949 | 1980 .. | 1 | 45 [] | 33.1 | 6.4e-06 |

```
EGF              6/6   1984  2018 ..   1   45 []    35.2   1.5e-06
HRM              1/1   2125  2182 ..   1   79 []    75.6   1.1e-18
GPS              1/1   2475  2528 ..   1   54 []    85.7   9.4e-22
7tm_2            1/1   2535  2805 ..   1  273 []   320.5   2e-92
Sulfate_transp   1/1   3532  3842 ..   1  328 []   363.5   2.3e-105
STAS             1/1   3865  4053 ..   1  116 []    61.3   2e-14
```

Alignments of top-scoring domains:
cadherin: domain 1 of 9, from 329 to 423: score 89.9, E = 5e-23
(SEQ ID NO:72)          ysasvpEnapvGtevltvtAtDaDdplgpNgrirYsilggnp...gg
                                    |+  ||||++ || ||+| |+|+|    |
                        ||++||+      +++
    NOV2  (SEQ ID NO:178)  329    YQTLVPENEAAGTAVLRVVAQDPD--
AGEAGRLVYSLAALMNsrsLE 373 wFrIdpdtGdnegiiAtttkpLDREeifngeYeLtveAtDadplsaaggsp
                        |+|||++|    |+|++ |||++ +++ | | |+|+       |||
                    374 LFSIDPQSGL----IRTAAALDRESM--ERHYLRVTAQDH-------GSP 410 plsgtatvtitVl<-*
                        ||+|++| +||
                    411 RLSATTMVAVTVA    423 cadherin: domain 2 of 9, from 437 to 535: score 94.9, E = 1.6e-24
(SEQ ID NO:73)          ysasvpEnapvGtevltvtAtDaDdplgpNgrirYsilggnp.....
                                    |  +++||+  |  ++|+++||| |
                        +||+++||+++|++   +
    NOV2  (SEQ ID NO:179)  437    YRETLRENVEEGYPILQLRATDGD--
APPNANLRYRFVGPPAaraaa 481 ggwFrIdpdtGdnegiiAtttkpLDREeifngeYeLtveAtDadplsaagg
                        +  |+|||++|    |||  ++|||++  ++|||+|||+|+++
                    482 AAAFEIDPRSGL----ISTSGRVDREHM--ESYELVVEASDQGQ-----E 520 spplsgtatvtitVl<-*
                        +  |+|+|++|+||||
                    521 PGPRSATVRVHITVL    535 cadherin: domain 3 of 9, from 549 to 641: score 107.4, E = 2.7e-28
(SEQ ID NO:74)          ysasvpEnapvGtevltvtAtDaDdplgpNgrirYsilggnpggwFr
                                    |+|+|+|+++++ |  ||+|||||+|    +||
                        ++|  |++||++|+|+
    NOV2  (SEQ ID NO:180)  549    YVAQVREDVRPHTVVLRVTATDRD--
KDANGLVHYNIISGNSRGHFA 593

IdpdtGdnegiiAtttkpLDREeifngeYeLtveAtDadplsaaggsppls
                        ||+ ||+   | +++|||  |+   +|| |  ++|+|||         | ||||
                    594 IDSLTGE----IQVVAPLDFEAE--REYALRIRAQDA-------GRPPLS 630

.gtatvtitVl<-*
                        ++|+   |+|
                    631 nNTGLASIQVV    641 cadherin: domain 4 of 9, from 655 to 746: score 103.9, E = 3.2e-27
(SEQ ID NO:75)          ysasvpEnapvGtevltvtAtDaDdplgpNgrirYsilggnpggwFr
                                    +++||  ||||  |  +|++++|+|||    +|
                        |+|+  ||++|   |+  |
    NOV2  (SEQ ID NO:181)  655    FQVSVLENAPLGHSVIHIQAVDAD--
HGENARLEYSLTGVAPDTPFV 699

IdpdtGdnegiiAtttkpLDREeifngeYeLtveAtDadplsaaggsppls
                        |+++||+    +|+  ||||+  +  |   + ||||+|+          |||||
                    700 INSATGW----VSVSGPLDRESV--EHYFFGVEARDH-------GSPPLS 736

```
                            gtatvtitVl<-*
                            + |+||+|||
                        737 ASASVTVTVL    746 cadherin: domain 5 of 9, from 760 to 848: score 76.9, E = 4.3e-19
           (SEQ ID NO:76)        ysasvpEnapvGtevltvtAtDaDdplgpNgrirYsilggnpggwFr
                                 |+ ++ |+|+|||+| +|||+|+|    +|+
|+| |+||| ++ |+
        NOV2     (SEQ ID NO:194)  760    YHLRLNEDAAVGTSVVSVTAVDRD----
ANSAISYQITGGNTRNRFA 802

IdpdtGdnegiisttkpLDREeifngeYeLtveAtDadplsaaggsppls
                            | ++ |+ |+++++ |||+ +  + + |++ |+|+        +|
                        803 ISTQGGV--GLVTLALPLDYKQE--RYFKLVLTASDR---------ALH 838 gtatvtitVl<-*
                            + ++|+|+++
                        839 DHCYVHINIT    848 cadherin: domain 6 of 9, from 862 to 951: score 80.0, E = 4.7e-20
           (SEQ ID NO:77)        ysasvpEnapvGtevltvtAtDaDdplgpNgrirYsilggnpggwFr
                                 ||+|| |+ | |+++ ++ |+| |   |
|+||+| +|++|   +||
        NOV2     (SEQ ID NO:195)  862    YSVSVNEDRPMGSTIVVISASDDD--VGENARITY-LLEDN-
LPQFR 904

IdpdtGdnegiisttkpLDREeifngeYeLtveAtDadplsaaggsppls
                            || |+|     |++++|||+| +  +|+| + |+|+     | | +
                        905 IDADSGA----ITLQAPLDYEDQ--VTYTLAITARDN-------GIPQKA 941 gtatvtitVl<-*
                            +|++| + |
                        942 DTTYVEVMVN    951 cadherin: domain 7 of 9, from 965 to 1057: score 99.7, E = 5.8e-26
           (SEQ ID NO:78)        ysasvpEnapvGtevltvtAtDaDdplgpNgrirYsilggnp.ggwF
                                 |++ |+|+||+ |+||++ |||+|
+|||+ | + +|+ ++| |
        NOV2     (SEQ ID NO:207)  965    YTGLVSEDAPPFTSVLQISATDRD--
AHANGRVQYTFQNGEDgDGDF 1009 rIdpdtGdnegiisttkpLDREeifngeYeLtveAtDadplsaaggsppl
                            +|+| +|    ++|+++|||+   + |||| +|+|+    | |||
                       1010 TIEPTSGI----VRTVRRLDREAV--SVYELTAYAVDR-------GVPPL 1046 sgtatvtitVl<-*
                            ++++++ + |+
                       1047 RTPVSIQVMVQ    1057 cadherin: domain 8 of 9, from 1071 to 1159: score 87.4, E = 2.8e-22
           (SEQ ID NO:79)        ysasvpEnapvGtevltvtAtDaDdplgpNgrirYsilggnpggwFr
                                 ++++|+||+ ||+ |+++||+|+|   +|||+
| | |++||| + |
        NOV2     (SEQ ID NO:208) 1071    FEVRVKENSIVGSVVAQITAVDPD--
EGPNAHIMYQIVEGNIPELFQ 1115

IdpdtGdnegiisttkpLDREeifngeYeLtveAtDadplsaaggsppls
                            +| +|+    ++  ||+|++ +||+++| ||       ||
                       1116 MDIFSGE----LTALIDLDYEAR--QEYVIVVQATSA----------PLV 1149 gtatvtitVl<-*
                            ++|||++ +
                       1150 SRATVHVRLV    1159
```

```
EGF: domain 2 of 6, from 1438 to 1469: score 33.3, E = 5.6e-06
(SEQ ID NO:80)         CapnnpCsngGtCvntpggssdnfggytCeCppGdyylsytGkrC<-
                                    |+|  ||  |||  |    +|        ||||+|
|    +|  |++|
       NOV2    (SEQ ID NO:209) 1438         CYSN-PCRNGGACARREG-------GYTCVCRPR-----
FTGEDC    1469

EGF: domain 3 of 6, from 1478 to 1512: score 35.8, E = 9.8e-07
(SEQ ID NO:81)         CapnnpCsngGtCvntpggssdnfggytCeCppGdyylsytGkrC<-
                                    |  |+  +|  ||||||++  |+
||++|+||  |      ++  |+||
       NOV2    (SEQ ID NO:210) 1478         CVPG-VCRNGGTCTDAPN------GGFRCQCPAG---
GAFEGPRC  1512 laminin_G: domain 1 of 3, from 1542 to 1606: score 56.1, E = 8.2e-15
(SEQ ID NO:82)         FRTtepsGlLllgYggtntdrggkkeigdDFlaleLvdGrlevsydl
                                    |+|  ++|||||+    |+|    +++
|||||||||  |+++++|++
       NOV2    (SEQ ID NO:211) 1542    FATVQQSGLLF--YNGRLNEKH-------
DFLALELVAGQVRLTYST  1579

GsghrlrpavvrsgdrvlnDGkWHrveler<-*
                       |    +  ++ ++++  |+||+||+|+|++
                  1580 GESN--TVVSPTVPGG-LSDGQWHTVHLRY    1606

EGF: domain 4 of 6, from 1725 to 1756: score 40.4, E = 4.1e-08
(SEQ ID NO:83)         CapnnpCsngGtCvntpggssdnfggytCeCppGdyylsytGkrC<-
                                    |+++  ||+|   |+|   +  +|
+++|+||+|      +  ||+|
       NOV2    (SEQ ID NO:335) 1725         CDSG-PCKNSGFCSERWG-------SFSCDCPVG-----
FGGKDC    1756 laminin_G: domain 3 of 3, from 1792 to 1926: score 30.4, E = 1.9e-07
(SEQ ID NO:84)         FRTtepsGlLllgYggtntdrggkkeigdDFlaleLvdGrlevsydl
                                    |||++++|+|+      ++  ++
|+  +|  +|  |  |++
       NOV2    (SEQ ID NO:336) 1792     FRTRATQGVLM---QVQAGPHST--------
LLCQLDRGLLSVTVTR  1827

Gsghrlrpavvrsgdrvlndgkwhrvele........rngrkgtLsVdge
                       |||    |+  ++    +  +++||+||  +  ||  +++++++|  ++  +++|+|
                  1828 GSG---RASHLLLDQVTVSDGRWHDLRLElqeepggrRGHHVLMVSLDFS  1874 epskktlsetvvdgespsgpdvtsenLdldtppiLyvGGlPeqksvkrrl
                        +  ++  +|++      +  |+  +  +|  |||||    ++ ++++
                  1875 L----------FQDTMAVGSEL----QGLKVK-QLHVGGLP--PGSAEEA  1907 aaistsFkGCirdvsingkpld<-*
                       +++|||+  |++++  |  +
                  1908 ---PQGLVGCIQGVWLGSTPSG    1926

EGF: domain 5 of 6, from 1949 to 1980: score 33.1, E = 6.4e-06
(SEQ ID NO:85)         CapnnpCsngGtCvntpggssdnfggytCeCppGdyylsytGkrC<-
                                    ||++  ||    ++  |+++++
+++|+|+||       |  |+  |
       NOV2    (SEQ ID NO:337) 1949         CASG-PCPPHADCRDLWQ-------TFSCTCQPG-----
YYGPGC    1980
```

```
       EGF: domain 6 of 6, from 1984 to 2018: score 35.2, E = 1.5e-06
       (SEQ ID NO:86)       CapnnpCsngGtCvntpggssdnfggytCeCppGdyylsytGkrC<-
                                    |+|  ||+|  |  |+ +||    + +||||+|
|   |  |++|
       NOV2    (SEQ ID NO:338) 1984   CLLN-PCQNQGSCRHLPG----APHGYTCDCVGG-----
YFGHHC  2018

HRM: domain 1 of 1, from 2125 to 2182: score 75.6, E = 1.1e-18
       (SEQ ID NO:87)       glyCpatwDgilCWPrTpaGtlvvvpCPdyfsGfnydttgedfsngn
                                     +++||++    +++||+|++|+|++||||+++
|+
       NOV2    (SEQ ID NO:339) 2125   YDACPKSLRSGVWWPQTKFGVLATVPCPRGALGA---------
---- 2158 asRnCtenGwwerhpnsnwpwpdytnCtspey<-*
                              |+|  |+|  ++|            ||++|||||   +
                       2159  AVRLCDEAQGWL--------EPDLFNCTSPAF      2182

GPS: domain 1 of 1, from 2475 to 2528: score 85.7, E = 9.4e-22
       (SEQ ID NO:88)       snpiCvfWdesel..slgvWstdrGCelvetskpshttCsCnHLTsF
                                    |++|||+||   |  +++|||++
|+||||++++  ||++|+|++ ++|
       NOV2    (SEQ ID NO:340) 2475   SKAICVQWDPPGLaeQHGVWTA-RDCELVHRNG-
SHARCRCSRTGTF 2519

AvLmdvspn<-*
                             +||||+||+
       NOV2    2520  GVLMDASPR    2528

7tm_2: domain 1 of 1, from 2535 to 2805: score 320.5, E = 2e-92
       (SEQ ID NO:89)       allLkviytVGyslSsLvcLllaiaifllfRkLrctRnyIHmNLfls
                                    ++||  |  ++|++++|
+++|+|++||+|++|+|+++    ||  |    ++
       NOV2    (SEQ ID NO:341) 2535   LELLAVFTHVVVAVS-
VAALVLTAAILLSLRSLKSNVRGIHANVAAA 2580 fiLralsfLigdavllnsg............................Ckv
                             + +++|+||+|+++++|++++++++++   +   ++ +++++++ |++
                       2581  LGVAELLFLLGIHRTHNQVqdqgqgtcvlmtllaqeawgqnsgselvCTA 2630 vavflhYfflaNFfWmLvEGlYLytLlvvtvevffserkrlwwYlliGWG
                             ||++|||||||++|+|++| ||+||++   ||+++ +|+ +++|+++|||
                       2631  VAILLHYFFLSTFAWLFVQGLHLYRMQ---VEPRNVDRGAMRFYHALGWG 2677 vPavfvtiwaivrpdkygpilaegpagygnegcCWlsndtnsgfwWiikG
                             ||||+ +++++++|+          ||||+++||+|  +++++|+++|
                       2678  VPAVLLGLAVGLDPE----------GYGNPDFCWISV--HEPLIWSFAG 2714

PilliilvNfiffinilriLvqKlridslspqtgetdqyrkkrlvkstLl
                             |++|+|++|   +|++++|+ ++  +     +++++|+  |    +++|++|
                       2715  PVVLVIVMNGTMFLLAARTSCSTGQ-----REAKKTSALR---TLRSSFL 2756

LlPLLGvtwilflfapedqsqGtlslvflylfliLnSfQGffVavlYCfl
                             ||+|+ +|+++|+|+++        + |+|+||+++|+ +||+ | +|+|+|
                       2757  LLLLVSASWLFGLLAVNH-----SILAFHYLHAGLCGLQGLAVLLLFCVL 2801

NgEV<-*
                             | +
                       2802  NADA    2805

Sulfate_transp: domain 1 of 1, from 3532 to 3842: score 363.5, E = 2.3e-105
```

```
       (SEQ ID NO:90)              lGllRLGfLvefl5ravisGFmaGaAilIllsQLkgllGlsnlftrh
                                    |||  +||+|++||++++  |++++||+
+++|||+++||+  +++|
        NOV2      (SEQ ID NO:342) 3532      LGLIHFGFVVTYLSEPLVRGYTTAAAVQVFVSQLKYVFGLH-
-LSSH 3576 sgivsvlralfdlvdnlhdflkwnwatlvigisfLifLliikllpnpkkr
                              ||+ |++ +++ ++ +|+   + ++ |+|+++++ ++| ++|||+    +
                         3577 SGPLSLIYTVLEVCWKLP---QSKVGTVVTAAVAGVVLVVVKLLN---DK 3620 kkklfwvpapapLvavilaTlisylfnrhkladrygvsivGeipsGlppp
                              +   ++ |+|++|+ +|+||+|||  +   +|++|+ |++||+|| || ||
                         3621 LQQQLPMPIPGELLTLIGATGISYGM---GLKHRFEVDVVGNIPAGLVPP 3667 slPrlnlspstlldllpialalAlvgllesiltaksfakikgykiDsNkE
                              |+++|  +++++ ++  |     |+||++ +|+ +|  ||  ++||++|||+|
                         3668 VAPNTQLFSKLVGSAFTI----AVVGFAIAISLGKIFALRHGYRVDSNQE 3713

LvAqGiaNIvgslfggypatgsfsRSavNvkaGakTqLSgivmavvvllv
                              |||+|++|++|+  |  ++|+++|  |||+|++++|+++|++|  ++++++||+
                         3714 LVALGLSNLIGGIFQCFPVSCSMSRSLVQESTGGNSQVAGAISSLFILLI 3763 lLfltplleyiPmavLaaIiivaligmLidwselirllwklsklDfliwl
                              ++ |+ |++ +|+|||||||||+|+|||+++|+++   ||| ++ |  ||||
                         3764 IVKLGELFHDLPKAVLAAIIIVNLKGMLRQLSDMRS-LWKANRADLLIWL 3812 atffgtvfvdNleiGvlvGVaiSllflilrv<-*
                              +||   |+++  |  |++|+|++|||  +++|+
                         3813 VTFTATILLN-LDLGLVVAVIFSLLLVVVRT     3842

STAS: domain 1 of 1, from 3865 to 4053: score 61.3, E = 2e-14
         (SEQ ID NO:91)            yieaetipgievlilrlsGpLdfanae.lkerllraiaegperk...
                                          |  ||++  |+  +++|  |+ ++|||||        +
| + ++ +    ++
        NOV2    (SEQ ID NO:343) 3865          YSEAKEVRGV--
KVFRSSATVYFANAEfYSDALKQRCGVD---Vdfl 3906

................................................
                                 +++++  +++++ + ++ +++++ +++ ++  +    +++ +++++ ++
                            3907 isqkkkllkkqeqlklkqlqkeeklrkqagpllsaclapqqvssgdkmed 3956

.......................kielrhvilDlsaVsfiDssGlgaLle
                                 + +++++++ +++++ +  + ++++ + +||||  |+||+|+   |  |++
                            3957 atangqedskapdgstlkalglpQPDFHSLILDLGALSFVDTVCLKSLKN 4006 lykelkkrGvelvLvgpspevrrtleltGlddligke.kifptvaeA<-*
                                 ++++++ + ||++++ ++  |  ||+++++|  + ++++|++|++|
                            4007 IFHDFREIEVEVYMAACHSPVVSQLEAGHFFDASITKkHLFASVHDA    4053
```

The nucleic acids and proteins of the invention are useful in potential diagnostic and therapeutic applications implicated in various diseases and disorders described below and/or other pathologies. For example, the compositions of the present invention will have efficacy for treatment of patients such as Mucopolysaccharidosis type IX; Colorectal cancer, hereditary nonpolyposis, type 2; Turcotsyndrome with glioblastoma, 276300; Muir-Torre family cancer syndrome, 158320; Neurofibromatosis type 1 and leukemia; Hemolytic anemia due to glutathione peroxidase deficiency; Epidermolysis bullosa dystrophica, dominant, 131750; Epidermolysis bullosa dystrophica, recessive, 226600; Epidermolysis bullosa, pretibial, 131850; Metaphyseal chondrodysplasia, Murk Jansen type, 156400; Colorectal cancer; Hepatoblastoma; Pilomatricoma; Ovarian carcinoma, endometrioid type.

The protein similarity information for the invention(s) suggest that this gene may function as MEGF, Flamingo or cadherin family genes in the tissues in which it is expressed and in the pathologies in which it has been implicated (Tissue expression and disease association section). Therefore, the nucleic acids and proteins of the invention are useful in potential therapeutic applications implicated in various pathologies/disorders described previously and/or other pathologies/disorders associated with the tissues in which it is expressed, as well as disorders that MEGF, Flamingo and cadherin family members have been implicated. This gene is expressed in the following tissues: Thalamus, Fetal Brain. Since this protein's transcript was found in brain tissue, the gene encoding for it may be implicated in the following (but not limited to) neurodegenerative disorders: Dementia, Amyotrophic Lateral Sclerosis, Alzheimer Disease, Dystonia, Optic Atrophy and Huntington Disease. Additional disease indications and tissue expression for NOV2 and NOV2 variants, if available, are presented in the Examples.

Screening exploits 5'-end single-pass sequence data obtained from a pool of cDNAs whose sizes exceed 5 kb. Using this screening procedure, five known and nine new genes for proteins with multiple EGF-like-motifs from 8000 redundant human brain cDNA clones were identified. These new genes were found to encode a novel mammalian homologue of Drosophila fat protein, two seven-transmembrane proteins containing multiple cadherin and EGF-like motifs, two mammalian homologues of Drosophila slit protein, an unidentified LDL receptor-like protein, and three totally uncharacterized proteins. The organization of the domains in the proteins, together with their expression profiles and fine chromosomal locations, has indicated their biological significance, demonstrating that motif-trap screening is a powerful tool for the discovery of new genes that have been difficult to identify by conventional methods. Genomics 1998 Jul. 1; 51(1):27–34 PMID: 9693030, UI: 98360089

Flamingo, a seven-pass transmembrane cadherin, regulates planar cell polarity under the control of Frizzled. A seven-pass transmembrane receptor of the cadherin superfamily, designated Flamingo (Fmi), localized to cell—cell boundaries in the Drosophila wing. In the absence of Fmi, planar polarity was distorted. Before morphological polarization of wing cells along the proximal-distal (P-D) axis, Fmi was redistributed predominantly to proximal and distal cell edges. This biased localization of Fmi appears to be driven by an imbalance of the activity of Frizzled (Fz) across the proximal/distal cell boundary. These results, together with phenotypes caused by ectopic expression of fz and fmi, suggest that cells acquire the P-D polarity by way of the Fz-dependent boundary localization of Fmi. Cell 1999 Sep. 3; 98(5):585–95 PMID: 10490098, UI: 99418630

The various functions of MEGF, Flamingo and cadherin family members include, but are not limited to cell to cell adhesion, cell to matrix adhesion, receptor-ligand interactions, immunological functions, vaso-permeability, cell recognition, tissue morphogenesis, cell proliferation, invasion and metastasis of malignant tumors.

Cell-cell and cell-matrix interactions that involve adhesion molecules like cadherins are important in many developmental processes. Cadherins mediate homophilic, calcium-dependent cell—cell adhesion in a wide variety of tissues and are important regulators of morphogenesis, and loss of function may be involved in the invasion and metastasis of malignant tumors. (OMIM ID600976)

NOV3

A disclosed NOV3 nucleic acid (SEQ ID NO:5) of 1438 nucleotides (also referred to as CG55806-01) encoding a novel Coagulation Factor IX Precursor-like protein is shown in Table 3A. An open reading frame was identified beginning with an ATG initiation codon at nucleotides 2–4 and ending with a TAA codon at nucleotides 1184–1186. Putative untranslated regions are found upstream from the initiation codon and downstream from the termination codon, and are underlined. The start and stop codons are shown in bold letters in Table 3A.

TABLE 3A

NOV3 nucleotide sequence.

| |
|---|
| TATGCAGCGCGTGAACATGATCATGGCAGAATCACCAGGCCTCATCACCATCTGCCTTTTAGGA    (SEQ ID NO:5) |
| TATCTACTCAGTGCTGAATGTACAGTTTTTCTTGATCATGAAAACGCCAACAAAATTCTGAATC |
| GGCCAAAGAGGTATAATTCAGGTAAATTGGAAGAGTTTGTTCAAGGGAACCTTGAGAGAGAATG |
| TCTGGAGGAAAAGTGTAGTTTTGAAGAAGCACGAGAAGTTTTTGAAAACACTGAAAGAACAACT |
| GAATTTTGGAAGCAGTATGTTGATGGAGATCAGTGTGAGTCCAATCCATGTTTAAATGGCGGCA |
| GTTGCAAGGATGACATTAATTCCTATGAATGTTGGTGTCCCTTTGGATTTGAAGGAAAGAACTG |
| TGAATTAGATGTGGACTATGTAAATTCTACTGAAGCTGAAACCATTTTGGATAACATCACTCAA |
| AGCACCCAATCATTTAATGACTTCACTCGGGTTGTTGGTGGAGAAGATGCCAAACCAGGTCAAT |
| TCCCTTGGCAGGTTGTTTTGAATGGTAAAGTTGATGCATTCTGTGGAGGCTCTATCGTTAATGA |

TABLE 3A-continued

NOV3 nucleotide sequence.

AAAATGGATTGTAACTGCTGCCCACTGTGTTGAAACTGGTGTTAAAATTACAGTTGTCGCAGGT

GAACATAATATTGAGGAGACAGAACATACAGAGCAAAAGCGAAATGTGATTCGAATTATTCCTC

ACCACAACTACAATGCAGCTATTAATAAGTACAACCATGACATTGCCCTTCTGGAACTGGACGA

ACCCTTAGTGCTAAACAGCTACGTTACACCTATTTGCATTGCTGACAAGGAATACACGAACATC

TTCCTCAAATTTGGATCTGGCTATGTAAGTGGCTGGGGAAGAGTCTTCCACAAAGGGAGATCAG

CTTTAGTTCTTCAGTACCTTAGAGTTCCACTTGTTGACCGAGCCACATGTCTTCGATCTACAAA

GTTCACCATCTATAACAACATGTTCTGTGCTGGCTTCCATGAAGGAGGTAGAGATTCATGTCAA

GGAGATAGTGGGGGACCCCATGTTACTGAAGTGGAAGGGACCAGTTTCTTAACTGGAATTATTA

GCTGGGGTGAAGAGTGTGCAATGAAAGGCAAATATGGAATATATACCAAGGTATCCCGGTATGT

CAACTGGATTAAGGAAAAAACAAAGCTCACTTAATGAAAGATGGATTTCCAAGGTTAATTCATT

GGAATTGAAAATTAACAGGGCCTCTCACTAACTAATCACTTTCCCATCTTTTGTTAGATTTGAA

TATATACATTCTATGATCATTGCTTTTTCTCTTTACAGGGGAGAATTTCATATTTTACCTGAGC

AAATTGATTAGAAAATGGAACCACTAGAGGAATATAATGTGTTAGGAAATTACAGTCATTTCTA

AGGGCCCAGCCTTGACAAATTGTGAGTAAA

The NOV3 disclosed in this invention maps to chromosome X.

In a search of sequence databases, it was found, for example, that the nucleic acid sequence of this invention has 1047 of 1047 bases (100%) identical to a gb:GENBANK-ID:A13997|acc:A13997.1 mRNA from Homo sapiens (H. sapiens mRNA for factor IX).

A disclosed NOV3 polypeptide (SEQ ID NO:6) encoded by SEQ ID NO:5 has 394 amino acid residues and is presented in Table 3B using the one-letter amino acid code. SignalP, Psort and/or Hydropathy results predict that NOV3 The results predict that this sequence is likely to be localized extracellularly with a certainty of 0.5947. In an alternative embodiment, NOV3 is likely to be localized to the lysosome (lumen) with a certainty of 0.1900, or to the endoplasmic reticulum (membrane) with a certainty of 0.1000, or to the endoplasmic reticulum (lumen) with a certainty 0.1000. The most likely cleavage site for a NOV3 peptide is between amino acids 25 and 26, i.e., at the dash between amino acids LLS-AE.

The full amino acid sequence of the protein of the invention was found to have 264 of 264 amino acid residues (100%) identical to, and 264 of 264 amino acid residues (100%) similar to, the 461 amino acid residue ptnr:SWIS-SPROT-ACC:P00740 protein from Homo sapiens (Human) (COAGULATION FACTOR IX PRECURSOR (EC 3.4.21.22) (CHRISTMAS FACTOR)).

In a further search of public sequence databases, NOV3 was found to have homology to the amino acid sequences shown in the BLASTP data listed in Table 3C.

TABLE 3B

Encoded NOV3 protein sequence.

MQRVNMIMAESPGLITICLLGYLLSAECTVFLDHENANKILNRPKRYNSGKLEEFVQGNLEREC   (SEQ ID NO:6)

LEEKCSFEEAREVFENTERTTEFWKQYVDGDQCESNPCLNGGSCKDDINSYECWCPFGFEGKNC

ELDVDYVNSTEAETILDNITQSTQSFNDFTRVVGGEDAKPGQFPWQVVLNGKVDAFCGGSIVNE

KWIVTAAHCVETGVKITVVAGEHNIEETEHTEQKRNVIRIIPHHNYNAAINKYNHDIALLELDE

PLVLNSYVTPICIADKEYTNIFLKFGSGYVSGWGRVFHKGRSALVLQYLRVPLVDRATCLRSTK

FTIYNNMFCAGFHEGGRDSCQGDSGGPHVTEVEGTSFLTGIISWGEECAMKGKYGIYTKVSRYV

NWIKEKTKLT

TABLE 3C

BLASTP results for NOV3

| Gene Index/ Identifier | Protein/Organism | Length (aa) | Identity (%) | Positives (%) | Expect |
|---|---|---|---|---|---|
| ptnr: SWISSPROT- ACC: P00740 | Coagulation factor IX precursor (EC 3.4.21.22) (Christmas factor) - *Homo sapiens* | 461 | 264/264 (100%) | 264/264 (100%) | 2.0e−219 |
| ptnr: REMTREMBL- ACC: CAA00205 | FACTOR IX - *Homo sapiens* | 461 | 264/264 (100%) | 264/264 (100%) | 2.0e−219 |
| ptnr: SPTREMBL- ACC: Q95ND7 | COAGULATION FACTOR XI - *Pan troglodytes* | 461 | 263/264 (99%) | 264/264 (100%) | 4.2e−219 |
| ptnr: SPTREMBL- ACC: Q14316 | F9 (COAGULATION FACTOR IX (PLASMA THROMBOPLASTIC COMPONENT, CHRISTMAS DISEASE, HAEMOPHILIA B)) (FACTOR IX) - *Homo sapiens* | 456 | 264/264 (100%) | 264/264 (100%) | 8.9e−217 |
| ptnr: REMTREMBL- ACC: CAA01607 | FACTOR IX PROTEIN - *Homo sapiens* | 456 | 262/264 (99%) | 262/264 (99%) | 1.7e−215 |

The homology of these sequences is shown graphically in the ClustalW analysis shown in Table 3D. The NOV3 polypeptide is provided in lane 1.

Table 3D. ClustalW Analysis of NOV3

1) NOV3      (SEQ ID NO:6)
2) P00740    (SEQ ID NO:92)
3) CAA00205  (SEQ ID NO:93)
4) Q95ND7    (SEQ ID NO:94)
5) Q14316    (SEQ ID NO:95)
6) CAA01607  (SEQ ID NO:96)

```
                 10        20        30        40        50        60        70        80
           ....|....|....|....|....|....|....|....|....|....|....|....|....|....|....|....|
NOV3       MQRVNMIMAESPGLITICLLGYLLSAECTVFLDHENANKILNRPKRYNSGKLEEFVQGNLERECEEKCSFEEAREVFEN
P00740     MQRVNMIMAESPGLITICLLGYLLSAECTVFLDHENANKILNRPKRYNSGKLEEFVQGNLERECMEEKCSFEEAREVFEN
CAA00205   MQRVNMIMAESPGLITICLLGYLLSAECTVFLDHENANKILNRPKRYNSGKLEEFVQGNLERECMEEKCSFEEAREVFEN
Q95ND7     MQRVNMIMAESPGLITICLLGYLLSAECTVFLDHENANKILNRPKRYNSGKLEEFVQGNLERECMEEKCSFEEAREVFEN
Q14316     -----MIMAESPGLITICLLGYLLSAECTVFLDHENANKILNRPKRYNSGKLEEFVQGNLERECMEEKCSFEEAREVFEN
CAA01607   -----MIMAESPGLITICLLGYLLSAECTVFLDHENANKILNRPKRYNSGKLEEFVQGNLERECMEEKCSFEEAREVFEN 90       100       110       120       130       140       150       160
           ....|....|....|....|....|....|....|....|....|....|....|....|....|....|....|....|
NOV3       TERTTEFWKQYVDGDQCESNPCLNGGSCKDDINSYECWCPFGFEGKNCELDV---------------------------
P00740     TERTTEFWKQYVDGDQCESNPCLNGGSCKDDINSYECWCPFGFEGKNCELDVTCNIKNGRCEQFCKNSADNKVVCSCTEG
CAA00205   TERTTEFWKQYVDGDQCESNPCLNGGSCKDDINSYECWCPFGFEGKNCELDVTCNIKNGRCEQFCKNSADNKVVCSCTEG
Q95ND7     TERTTEFWKQYVDGDQCESNPCLNGGSCKDDINSYECWCPFGFEGKNCELDVTCNIKNGRCEQFCKNSADNKVVCSCTEG
Q14316     TERTTEFWKQYVDGDQCESNPCLNGGSCKDDINSYECWCPFGFEGKNCELDVTCNIKNGRCEQFCKNSADNKVVCSCTEG
CAA01607   TERTTEFWKQYVDGDQCESNPCLNGGSCKDDINSYECWCPFGFEGKNCELDVTCNIKNGTCEQFCKNSADNKVVCSCTEG 170       180       190       200       210       220       230       240
           ....|....|....|....|....|....|....|....|....|....|....|....|....|....|....|....|
NOV3       ----------------------------------------DYVNSTEAETILDNITQSTQSFNDFTRVVGGEDAKPGQFPW
P00740     YRLAENQKSCEPAVPFPCGRVSVSQTSKLTRAEAVFPDVDYVNSTEAETILDNITQSTQSFNDFTRVVGGEDAKPGQFPW
CAA00205   YRLAENQKSCEPAVPFPCGRVSVSQTSKLTRAETVFPDVDYVNSTEAETILDNITQSTQSFNDFTRVVGGEDAKPGQFPW
Q95ND7     YRLAENQKSCEPAVPFPCGRVSVSQTSKLTRAETVFPDVDYVNSTEAETILDNITQSTQSFNDFTRVVGGEDAKPGQFPW
Q14316     YRLAENQKSCEPAVPFPCGRVSVSQTSKLTRAETVFPDVDYVNSTEAETILDNITQSTQSFNDFTRVVGGEDAKPGQFPW
CAA01607   YRLAENQKSCEPAVPFPCGRVSVSQTSKLTRAEAVFPDVDYVNSTEAETILDNITQSTQSFNDFTRVVGGEDAKPGQFPW 250       260       270       280       290       300       310       320
           ....|....|....|....|....|....|....|....|....|....|....|....|....|....|....|....|
NOV3       QVVLNGKVDAFCGGSIVNEKWIVTAAHCVETGVKITVVAGEHNIEETEHTEQKRNVIRIIPHHNYNAAINKYNHDIALLE
P00740     QVVLNGKVDAFCGGSIVNEKWIVTAAHCVETGVKITVVAGEHNIEETEHTEQKRNVIRIIPHHNYNAAINKYNHDIALLE
CAA00205   QVVLNGKVDAFCGGSIVNEKWIVTAAHCVETGVKITVVAGEHNIEETEHTEQKRNVIRIIPHHNYNAAINKYNHDIALLE
Q95ND7     QVVLNGKVDAFCGGSIVNEKWIVTAAHCVDTGVKITVVAGEHNIEETEHTEQKRNVIRIIPHHNYNAAINKYNHDIALLE
Q14316     QVVLNGKVDAFCGGSIVNEKWIVTAAHCVETGVKITVVAGEHNIEETEHTEQKRNVIRIIPHHNYNAAINKYNHDIALLE
CAA01607   QVVLNGKVDAFCGGSIVNEKWIVTAAHCVETGVKITVVAGEHNIEETEHTEQKRNVIRIIPHHNYNAAINKYNHDIALLE
```

```
                    330        340        350        360        370        380        390        400
                 ....|....|....|....|....|....|....|....|....|....|....|....|....|....|....|
NOV3             LDEPLVLNSYVTPICIADKEYTNIFLKFGSGYVSGWGRVFHKGRSALVLQYLRVPLVDRATCLRSTKFTIYNNMFCAGFH
P00740           LDEPLVLNSYVTPICIADKEYTNIFLKFGSGYVSGWGRVFHKGRSALVLQYLRVPLVDRATCLRSTKFTIYNNMFCAGFH
CAA00205         LDEPLVLNSYVTPICIADKEYTNIFLKFGSGYVSGWGRVFHKGRSALVLQYLRVPLVDRATCLRSTKFTIYNNMFCAGFH
Q95ND7           LDEPLVLNSYVTPICIADKEYTNIFLKFGSGYVSGWGRVFHKGRSALVLQYLRVPLVDRATCLRSTKFTIYNNMFCAGFH
Q14316           LDEPLVLNSYVTPICIADKEYTNIFLKFGSGYVSGWGRVFHKGRSALVLQYLRVPLVDRATCLRSTKFTIYNNMFCAGFH
CAA01607         LDEPLVLNSYVTPICIADKEYTNIFLKFGSGYVSGWGRVFHKGRSALVLQYLRVPLVDRATCLRSTKFTIYNNMFCAGLH 410        420        430        440        450        460
                 ....|....|....|....|....|....|....|....|....|....|....|....|.
NOV3             EGGRDSCQGDSGGPHVTEVEGTSFLTGIISWGEECAMKGKYGIYTKVSRYVNWIKEKTKLT
P00740           EGGRDSCQGDSGGPHVTEVEGTSFLTGIISWGEECAMKGKYGIYTKVSRYVNWIKEKTKLT
CAA00205         EGGRDSCQGDSGGPHVTEVEGTSFLTGIISWGEECAMKGKYGIYTKVSRYVNWIKEKTKLT
Q95ND7           EGGRDSCQGDSGGPHVTEVEGTSFLTGIISWGEECAMKGKYGIYTKVSRYVNWIKEKTKLT
Q14316           EGGRDSCQGDSGGPHVTEVEGTSFLTGIISWGEECAMKGKYGIYTKVSRYVNWIKEKTKLT
CAA01607         EGARDSCQGDSGGPHVTEVEGTSFLTGIISWGEECAMKGKYGIYTKVSRYVNWIKEKTKLT
```

BLAST analysis was performed on sequences from the Patp database, which is a proprietary database that contains sequences published in patents and patent publications. Patp results include those listed in Table 3E.

TABLE 3E

Patp BLASTP Analysis for NOV3

| Sequences producing High-scoring Segment Pairs | Protein/Organism | Length (aa) | Identity (%) | Positive (%) | E Value |
| --- | --- | --- | --- | --- | --- |
| patp: AAP50311 | Sequence of human factor IX, encoded by DNA FIX - *Homo sapiens* | 461 | 264/264 (100%) | 264/264 (100%) | 1.6e–219 |
| patp: AAP50302 | Sequence of human factor IX - *Homo sapiens* | 461 | 264/264 (100%) | 264/264 (100%) | 1.6e–219 |
| patp: AAY97295 | Human clotting factor IX - *Homo sapiens* | 461 | 264/264 (100%) | 264/264 (100%) | 1.6e–219 |
| patp: AAB60281 | Human factor IX (hFIX) protein - *Homo sapiens* | 461 | 264/264 (100%) | 264/264 (100%) | 1.6e–219 |
| patp: AAP50019 | Sequence of human factor IX - *Homo sapiens* | 461 | 263/264 (99%) | 263/264 (99%) | 1.1e–218 |

Table 3F lists the domain description from DOMAIN analysis results against NOV3.

| Table 3F. Domain Analysis of NOV3 | | |
|---|---|---|
| PSSMs producing significant alignments: | Score(bits) | Evalue |
| gla | 77.4 | 2.9e-19 |
| EGF | 32.7 | 8.5e-06 |
| EB | -14.5 | 5.4 |
| trypsin | 313.9 | 7.1e-99 |

Alignments of top-scoring domains:
gla: domain 1 of 1, from 52 to 93: score 77.4, E = 2.9e-19
(SEQ ID NO:97)          leelrkgnlerEcleEvCeleeArEifedtegtqefwrkYyd<-*
                        |||+++|||||||||+|++||||+||+|+|||++|+|
NOV3       (SEQ ID NO:344)   52

```
LEEFVQGNLERECLEEKCSFEEAREVFENTERTTEFWKQYVD      93

EGF: domain 1 of 1, from 97 to 128: score 32.7, E = 8.5e-06
        (SEQ ID NO:98)        CapnnpCsngGtCvntpggssdnfggytCeCppGdyylsytGkrC<-
                                          |+| ||+||| | +  +      +|+| ||
|   + ||+|
        NOV3        (SEQ ID NO:345)  97   CESN-PCLNGGSCKDDIN-------SYECWCPFG-----
FEGKNC 128

EB: domain 1 of 1, from 79 to 128: score -14.5, E = 5.4
        (SEQ ID NO:99)        CpsgqVevnGeCvkkvaiGetGClaseQCpgrwpGSqCidgm....C
                                          +|  + | +|+     |++ |+++
|++     |  |  | +++ +|
        NOV3        (SEQ ID NO:346)  79   ---ENTERTTEFWKQYVDGDQ-CESNP-CLN---
GGSCKDDInsyeC 117 qCpeGftavnGvC<-*
                || ||   + +|
            118 WCPFGF--EGKNC      128 trypsin: domain 1 of 1, from 160 to 387: score 313.9, E = 7.1e-99
        (SEQ ID NO:100)       IvGGreaqpgsfgsPwqvslqvrsgggsrkhfCGGsLisenwVLTAA
                                +|||++|+||+|  |||| |+ +
|||||+++|+|++|||
        NOV3        (SEQ ID NO:347) 160   VVGGEDAKPGQF--PWQVVLNGKV-----
DAFCGGSIVNEKWIVTAA 199

HCvsgaasapassvrVSlsvrlGehnlsltegteqkfdvkktiivHpnyn
                |||+   + +  ++|    ++||||+++||  |||++| + ||+| |||
            200 HCVET--GVK---ITV----VAGEHNIEETEHTEQKRNVIR-IIPHHNYN 239 pdtldngaYdnDiALlkLkspgvtlgdtvrpicLps...assdlpvGttc
                +      | +|||||+|++| + |+++|  |||+++++ ++  |+ | ++
            240 AAINK---YNHDIALLELDEP-LVLNSYVTPICIADkeyTNIFLKFG-SG 284 tvsGwGrrptknlg.lsdtLqevvvpvvsretCrsayeyggtDkvefvt
                +||||||  +++ |+++ +||++ ||+|+|+||  ++  ++  |    ++
            285 YVSGWGR--VFHKGrSALVLQYLRVPLVDRATCLRS--TKFT------IY 324 dnmiCagal.ggkdaCqGDSGGPLvcsdgnrdgrwelvGivSwGsygCar
                +||+|||+  +||+|+|||||||||+++     |+ +|+|||| + ||
            325 NNMFCAGFHeGGRDSCQGDSGGPHVTEVE---GTSFLTGIISWG-EECAM 370 gnkPGvytrVssyldWI<-*
                ++|+|+|||+||+++||
            371 KGKYGIYTKVSRYVNWI     387
```

The Coagulation Factor IX Precursor disclosed in this invention is expressed in at least the following tissues: Adrenal Gland/Suprarenal gland, Artery, Bone, Brain, Colon, Lung, Mammary gland/Breast, Pituitary Gland, Placenta, Spleen, Substantia Nigra, Testis, Thalamus, Thyroid, Uterus, and Whole Organism.

The nucleic acids and proteins of the invention are useful in potential diagnostic and therapeutic applications implicated in various diseases and disorders described below and/or other pathologies. For example, the compositions of the present invention will have efficacy for treatment of patients suffering from: Hemophilia B and other diseases, disorders and conditions of the like. Additional disease indications and tissue expression for NOV3 and NOV3 variants, if available, are presented in the Examples.

Hemophilia B or Christmas disease is an X-linked condition caused by absent or reduced levels of functional coagulation factor IX. Based upon the peptide sequence of bovine factor IX, Jagadeeswaran et al. (Somat Cell Mol Genet 1984; 10:465–73) synthesized a 17-base pair oligonucleotide probe to screen a human liver cDNA library. A recombinant clone was identified with a 917-nucleotide insert whose sequence corresponds to 70% of the coding region of human factor IX. This factor IX cDNA was used to probe restriction endonuclease digested human DNA to identify a Taq I polymorphism associated with the genomic factor IX gene as well as to verify that there is a single copy of this gene per haploid genome. The factor IX cDNA was also used to map the locus for factor IX to a region from Xq26 to Xqter. The cloning of human factor IX cDNA and identification of a Taq I polymorphism and its regional localization will provide a means to study the molecular genetics of hemophilia B and permit linkage analysis with nearby loci.

NOV4

The NOV4 (alternatively referred to as CG55936-01) nucleic acid of 1108 nucleotides (SEQ ID NO:7) encodes a novel carbonic anhydrase IV precursor-like protein and is shown in Table 4A. An open reading frame for the mature protein was identified beginning with a ATG initiation codon at nucleotides 38–40 and ending with a TGA codon at nucleotides 1046–1048. Putative untranslated regions upstream from the start codon and downstream from the termination codon are underlined in Table 4A. The start and stop codons are in bold letters.

TABLE 4A

NOV4 Nucleotide Sequence (SEQ ID NO:7)
CGACCCCGGCTCAGAGGACTCTTTGCTGTCCCGCAAGATGCGGATGCTGCTGGCGCTCCTGGCCCTCTCCGCGGCG

CGGCCATCGGCCAGTGCAGAGTCACACTGGTGCTACGAGGTTCAAGCCGAGTCCTCCAACTACCCCTGCTTGGTGC

CAGTCAAGTGGGGTGGAAACTGCCAGAAGGACCGCCAGTCCCCCATCAACATCGTCACCACCAAGGCAAAGGTGGA

CAAAAAACTGGGACGCTTCTTCTTCTCTGGCTACGATAAGAAGCAAACGTGGACTGTCCAAAATAACGGGCACTCA

GTGATGATGTTGCTGGAGAACAAGGCCAGCATTTCTGGAGGAGGACTGCCTGCCCCATACCAGGCCAAACAGTTGC

ACCTGCACTGGTCCGACTTGCCATATAAGGGCTCGGAGCACAGCCTCGATGGGGAGCACTTTGCCATGGAGATGCA

CATAGTACATGAGAAAGAGAAGGGGACATCGAGGAATGTGAAAGAGGCCCAGGACCCTGAAGACGAAATTGCGGTG

CTGGCCTTTCTGGTGGAGATCGGGAGAATGAACTGGCCACCACCACTGGCTCCCTGCAGACTTTCTCAAGACCCTT

CCCTCCCTTTCCAGGCTGGAACCCAGGTGAACGAGGGCTTCCAGCCACTGGTGGAGGCACTGTCTAATATCCCCAA

ACCTGAGATGAGCACTACGATGGCAGAGAGCAGCCTGTTGGACCTGCTCCCCAAGGAGGAGAAACTGAGGCACTAC

TTCCGCTACCTGGGCTCACTCACCACACCGACCTGCGATGAGAAGGTCGTCTGGACTGTGTTCCGGGAGCCCATTC

AGCTTCACAGAGAACAGATCCTGGCATTCTCTCAGAAGCTGTACTACGACAAGGAACAGACAGTGAGCATGAAGGA

CAATGTCAGGCCCCTGCAGCAGCTGGGGCAGCGCACGGTGATAAAGTCCGGGGCCCCGGGTCGGCCGCTGCCCTGG

GCCCTGCCTGCCCTGCTGGGCCCCATGCTGGCCTGCCTGCTGGCCGGCTTCCTGCCGATGATGGCTCACTTCTGCAC

GCAGCCTCTCTGTTGCCTCAGCTCTCCAAGTTCCAGGCTTCCGG

The NOV4 of the invention maps to chromosomes 17.

In a search of sequence databases, it was found, for example, that the NOV4 nucleic acid sequence of this invention has 586 of 608 bases (96%) identical to a gb:GENBANK-ID:HUMCAIVA|acc:M83670.1 mRNA from *Homo sapiens* (Human carbonic anhydrase IV mRNA, complete cds).

The NOV4 polypeptide (SEQ ID NO:8) encoded by SEQ ID NO:7 is 336 amino acid residues in length and is presented using the one-letter amino acid code in Table 4B. The SignalP, Psort and/or Hydropathy results predict that NOV4 has a signal peptide and is likely to be localized in the plasma membrane with a certainty of 0.9190. In alternative embodiments, a NOV4 polypeptide is located to the lysosome membrane with a certainty of 0.2000, the endoplasmic reticulum membrane with a certainty of 0.1000, or the endoplasmic reticulum lumen with a certainty of 0.1000. The SignalP predicts a likely cleavage site for a NOV4 peptide is between amino acid positions 19 and 20, i.e. at the dash in the sequence ASA-ES.

TABLE 4B

Encoded NOV4 Protein Sequence (SEQ ID NO:8)
MRMLLALLALSAARPSASAESHWCYEVQAESSNYPCLVPVKWGGNCQKDRQSPINIVTTKAKVDKKLGRFFFSGY

DKKQTWTVQNNGHSVMMLLENKASISGGGLPAPYQAKQLHLHWSDLPYKGSEHSLDGEHFAMEMHIVHEKEKGTS

RNVKEAQDPEDEIAVLAFLVEIGRMNWPPPLAPCRLSQDPSLPFQAGTQVNEGFQPLVEALSNIPKPEMSTTMAE

SSLLDLLPKEEKLRHYFRYLGSLTTPTCDEKVVWTVFREPIQLHREQILAFSQKLYYDKEQTVSMKDNVRPLQQL

GQRTVIKSGAPGRPLPWALPALLGPMLACLLAGFLR

The full amino acid sequence of the disclosed protein of the invention has 172 of 173 amino acid residues (99%) identical to, and 172 of 173 amino acid residues (99%) similar to, the 312 amino acid residue ptnr:SWISSNEW-ACC:P22748 protein from *Homo sapiens* (Human) (CARBONIC ANHYDRASE IV PRECURSOR (EC 4.2.1.1) (CARBONATE DEHYDRATASE IV) (CA-IV)).

The amino acid sequence of NOV4 has high homology to other proteins as shown in Table 4C.

TABLE 4C

NOV4 BLASTP Results

| Gene Index/ Identifier | Protein/Organism | Length of aa | Identity (%) | Positives (%) | Expect Value |
|---|---|---|---|---|---|
| P22748 | Carbonic anhydrase IV precursor (EC 4.2.1.1) (Carbonate dehydratase IV) (CA-IV) - *Homo sapiens* | 312 | 172/173 (99%) | 172/173 (99%) | 7.2e−167 |
| Q95323 | Carbonic anhydrase IV precursor (EC 4.2.1.1) (Carbonate dehydratase IV) (CA-IV) - *Bos taurus* (Bovine) | 312 | 125/203 (61%) | 144/203 (70%) | 3.4e−113 |
| P48283 | Carbonic anhydrase IV precursor (EC 4.2.1.1) (Carbonate dehydratase IV) (CA-IV) - *Oryctolagus cuniculus* (Rabbit) | 308 | 119/176 (67%) | 135/176 (76%) | 4.5e−107 |
| P48284 | Carbonic anhydrase IV precursor (EC 4.2.1.1) (Carbonate dehydratase IV) (CA-IV) - *Rattus norvegicus* (Rat) | 309 | 96/173 (55%) | 126/173 (72%) | 3.0e−93 |
| Q64444 | Carbonic anhydrase IV precursor (EC 4.2.1.1) (Carbonate dehydratase IV) (CA-IV) - *Mus musculus* (Mouse) | 305 | 94/173 (54%) | 120/173 (69%) | 1.3e−88 |

A multiple sequence alignment is given in Table 4D in a ClustalW analysis comparing NOV4 with related protein sequences disclosed in Table 4C.

TABLE 4D. CLUSTALW ANALYSIS OF NOV4

1. SEQ ID NO.: 8 NOV4
2. SEQ ID NO.: 101 P22748
3. SEQ ID NO.: 102 Q95323
4. SEQ ID NO.: 103 P48283
5. SEQ ID NO.: 104 P48284
6. SEQ ID NO.: 105 Q64444

```
                  10        20        30        40        50        60
         ....|....|....|....|....|....|....|....|....|....|....|....|
NOV4     MRMLLALLALSAARPSASAESHWCYEVQAESSNYPCLVPVKWGGNCQKDRQSPINIVTTK   60
```

```
                                        85                                          86
         P22748  MRMLLALLALSAARPSASAESHWCYEVQAESSNYPCLVPVKWGGNCQKDRQSPINIVTTK  60
         Q95323  MRLLLALLVLAAAPPQARAASHWCYQIQVKPSNYTCLEPDEWEGSCQNNRQSPVNIVTAK  60
         P48283  MQLLFALLALGALRPLAGEELHWCYEIQA--SNYSCLGPDKWQEDCQKSRQSPINIVTTK  58
         P48284  MQLLLALLALAYVAPST-EDSHWCYEIQAKEPNSHCSGPEQWTGDCKKNQQSPINIVTSK  59
         Q64444  MQLLLALLALAYVAPST-EDSGWCYEIQTKDPRSSCLGPEKWPGACKENQQSPINIVTAR  59

70        80        90       100       110       120
                 ....|....|....|....|....|....|....|....|....|....|....|....|
         NOV4    AKVDKKLGRFFFSGYDKKQTWTVQNNGHSVMMLLENKASISGGGLPAPYQAKQLHLHWSD 120
         P22748  AKVDKKLGRFFFSGYDKKQTWTVQNNGHSVMMLLENKASISGGGLPAPYQAKQLHLHWSD 120
         Q95323  TQLDPNLGRFSFSGYNMKHQWVVQNNGHTVMVLLENKPSIAGGGLSTRYQATQLHLHWSR 120
         P48283  AEVDHSLGRFHFSGYDQREARLVENNGHSVMVSLGDEISISGGGLPARYRATQLHLHWSQ 118
         P48284  TKLNPSLTPFTFVGYDQKKKWEVKNNQHSVEMSLGEDIYIFGGDLPTQYKAIQLHLHWSE 119
         Q64444  TKVNPRLTPFILVGYDKQQWPIKNNQHTVEMTLGGGACIIGGDLPARYEAVQLHLHWSN 119

130       140       150       160       170       180
                 ....|....|....|....|....|....|....|....|....|....|....|....|
         NOV4    LPYKGSEHSLDGEHFAMEMHIVHEKEKGTSRNVKEAQDPEDEIAVLAFLVEIGRMNWPPP 180
         P22748  LPYKGSEHSLDGEHFAMEMHIVHEKEKGTSRNVKEAQDPEDEIAVLAFLVEAG------- 173
         Q95323  AMDRGSEHSFDGERFAMEMHIVHEKEKGLSGNASQNQFAEDEIAVLAFMVEDG------- 173
         P48283  ELDRGSEHSLDGERSAMEMHIVHQKETGTSGN--EVQDSDDSIAVLAFLVEAG------- 169
         P48284  ESNKGSEHSIDGKHFAMEMHVVHKKMTTGDKVQ--DSDSKDKIAVLAFMVEVG------- 170
         Q64444  GNDNGSEHSIDGRHFAMEMHIVHKKLTS---S---KEDSKDKFAVLAFMIEVG------- 166

190       200       210       220       230       240
                 ....|....|....|....|....|....|....|....|....|....|....|....|
         NOV4    LAPCRLSQDPSLPFQAGTQVNEGFQPLVEALSNIPKPEMSTTMAES-SLLDLLPKEEKLR 239
         P22748  ------------------TQVNEGFQPLVEALSNIPKPEMSTTMAES-SLLDLLPKEEKLR 215
         Q95323  -----------------SKNVNFQPLVEALSDIPRPNMNTTMKEGVSLFDLLPEEESLR 215
         P48283  -----------------PTMNEGFQPLVTALSAISIPGTNTTMAPS-SLWDLLPAEEELR 211
         P48284  -----------------NEVNEGFQPLVEALSRLSKPFTNSTVSES-CLQDMLPEKKKLS 212
         Q64444  -----------------DKVNKGFQPLVEALPSISKPHSTSTVRES-SLQDMLPPSTKMY 208

250       260       270       280       290       300
                 ....|....|....|....|....|....|....|....|....|....|....|....|
         NOV4    HYFRYLGSLTTPTCDEKVVWTVFREPIQLHREQILAFSQKLYYDKEQTVSMKDNVRPLQQ 299
         P22748  HYFRYLGSLTTPTCDEKVVWTVFREPIQLHREQILAFSQKLYYDKEQTVSMKDNVRPLQQ 275
         Q95323  HYFRYLGSLTTPTCDEKVVWTVFQKPIQLHRDQILAFSQKLFYDDQKVNMTDNVRPVQS 275
         P48283  HYFRYMGSLTTPACSETVVWTVFQEPIRLHRDQILEFSSKLYYDQERKMNMKDNVRPLQR 271
         P48284  AYFRYQGSLTTPGCDETVIWTVFEEPIKIHKDQFLEFSKKLYYDQEQKLNMKDNVRPLQP 272
         Q64444  TYFRYNGSLTTPNCDETVIWTVYKQPIKIHKNQFLEFSKNLYYDEDQKLNMKDNVRPLQP 268

310       320       330
                 ....|....|....|....|....|....|..
         NOV4    LGQRTVIKSGAPGRPLPWALPALLGPMLACLLAGFLR 336
         P22748  LGQRTVIKSGAPGRPLPWALPALLGPMLACLLAGFLR 312
         Q95323  LGQRQVFRSGAPGLLLAQPLPTLLAPVLACLTVGFLR 312
         P48283  LGDRSVFKSQAAGQLLPLPLPTLLVPTLACVMAGLLR 308
         P48284  LGNRQVFRSHASGRLLSLPLPTLLVPTLTCLVASFLH 309
         Q64444  LGKRQVFKSHAPGQLLSLPLPTLLVPTLTCLVANFLQ 305
```

Additional BLAST results are shown in Table 4E.

TABLE 4E

Patp BLASTP Analysis for NOV4

| Sequences producing High-scoring Segment Pairs | Protein/Organism | Length (aa) | Identity (%) | Positive (%) | E Value |
|---|---|---|---|---|---|
| patp: AAB59591 | Human carbonic anhydrase isoform | 268 | 154/155 (99%) | 154/155 (99%) | 1.3e−143 |
| patp: AAB54035 | Human pancreatic cancer antigen protein sequence | 198 | 133/154 (86%) | 135/154 (87%) | 3.8e−69 |
| patp: AAR91952 | Lung cancer specific antigen HCAVIII truncated protein | 270 | 50/126 (39%) | 73/126 (57%) | 2.8e−32 |
| patp: AAR91953 | Lung cancer specific antigen HCAVIII truncated protein | 274 | 50/126 (39%) | 73/126 (57%) | 2.8e−32 |
| patp: AAR91950 | Lung cancer specific antigen HCAVIII pre-protein | 354 | 59/174 (33%) | 90/174 (51%) | 1.1e−30 |

Domain results for NOV4 were collected from the Pfam database, and then identified by the Interpro domain accession number. The results are listed in Table 4F with the statistics and domain description. These results indicate that the NOV4 polypeptide has properties similar to those of other proteins known to contain these domains.

TABLE 4F. DOMAIN ANALYSIS OF NOV4

| PSSMs Producing Significant Alignments | Score (bits) | E Value |
|---|---|---|
| carb_anhydrase: domain 1 of 2, from 23 to 176 | 294.4 | 1.4e-84 |

```
(SEQ ID NO:106)         WgYgehngpehsnnahvlWhklyPiAnGGnCqGerQSPInIqtkeak
                                              |+|++++++++
+++++|+++||+|++++||||+|++++++
 NOV4           (SEQ ID NO: 348) WCYEVQAESSN-------
YPCLVPVKWGGNCQKDRQSPINIVTTKAK yDPsLkpLslSYdaatakefeivNnGHsfqVeFdDsddksvlSGGPLpaG
            +|++|+++++|+++++++ ++++|+||++++ +++    +++++||+|++
  NOV4      VDKKLGRFFFSGYDKKQT-WTVQNNGHSVMMLLEN---KASISGGGLPAhpYRLkQfHFHWGGAssddqGSEHTVDGkkYaaELHLVHWNs.tKYgsyk
            +|+++|+|+||+  +++++||||++||+++++|+|+||+++++++++++
  NOV4      -PYQAKQLHLHWS--DLPYKGSEHSLDGEHFAMEMHIVHEKEkGTSRNVK eAvskpDGLAVlGvFlkvGdyqen
            +|++++|++||+++++++|  + +
  NOV4      EAQDPEDEIAVLAFLVEIG--RMN
```

| carb_anhydrase: domain 2 of 2, from 195 to 309 | 207.5 | 2.1e-58 |
|---|---|---|

```
(SEQ ID NO:107)         kvGdyqenpglqkvvDaLssIktKGksatftnFDPstLLPse.klrD
                                     ++| +++++++++++++|++|++++++++++++++
+|||+++++++
   NOV4          (SEQ ID NO:349) QAG-
TQVNEGFQPLVEALSNIPKPEMSTTMAESSLLDLLPKEeKLRH YWTYpGSLTTPPLtEsVtWiVlkepIsvSseQllkFRsLlfnaegeeevp
                        |++|+|||||||+++|+|+|+|++++|+++++|+++|++++++++ +++++
   NOV4                 YFRYLGSLTTPTCDEKVVWTVFREPIQLHREQILAFSQKLYYDK-EQTVS GCdGimvdNyRPtQPLkgRvVrASF
                           +++|+||+|+|++|+|++|+
   NOV4                 -----MKDNVRPLQQLGQRTVIKSG
```

The carbonic anhydrase disclosed in this invention is expressed in at least the following tissues: bone, brain, colon, kidney, lung, pancreas, parathyroid gland, peripheral blood, prostate, substantia nigra, and thalamus. This information was derived by determining the tissue sources of the sequences that were included in the invention including but not limited to SeqCalling sources, Public EST sources, Literature sources, and/or RACE sources.

The protein similarity information, expression pattern, and map location for the NOV4 protein and nucleic acid disclosed herein suggest that this protein may have important structural and/or physiological functions characteristic of the carbonic anhydrases family. Therefore, the NOV4 nucleic acids and proteins of the invention are useful in potential diagnostic and therapeutic applications and as a research tool. For example, the compositions of the present invention will have efficacy for treatment of patients suffering from: renal abnormalities, CO2 and HCO3-homeostasis in brain and other diseases, disorders and conditions of the like.

The novel NOV4 nucleic acids and polypeptides of the invention, or fragments thereof, are useful in diagnostic applications, wherein the presence or amount of the nucleic acid or the protein are to be assessed. These materials are further useful in the generation of antibodies that bind immunospecifically to the novel substances of the invention for use in therapeutic or diagnostic methods. These antibodies may be generated according to methods known to one ordinarily skilled in the art, using prediction from hydrophobicity charts, as described in the "Anti-NOVX Antibodies" section below.

The disclosed NOV4 protein of the invention has multiple hydrophilic regions, each of which can be used as an immunogen. The NOV4 protein also has value in the development of a powerful assay system for functional analysis of various human disorders, which will help in understanding of pathology of the disease and development of new drug targets for various disorders.

Carbonic anhydrases form a large family of genes encoding zinc metalloenzymes of great physiologic importance. As catalysts of the reversible hydration of carbon dioxide, these enzymes participate in a variety of biologic processes, including respiration, calcification, acid-base balance, bone resorption, and the formation of aqueous humor, cerebrospinal fluid, saliva, and gastric acid. Thus, it is likely that the NOV4 protein of the invention is accessible to a diagnostic probe and for the various therapeutic applications described herein.

NOV5

The NOV5 nucleic acid of 1806 nucleotides (SEQ ID NO:9) (alternatively referred to as CG55784-01) encodes a novel neural cell adhesion molecule-like protein and is shown in Table 5A. An open reading frame for the mature protein was identified beginning with an AAC initiation codon at nucleotides 1–3 and ending with a TAA codon at nucleotides 1645–1647. Putative untranslated regions downstream from the termination codon are underlined in Table 5A. The start and stop codons are in bold letters.

TABLE 5A

NOV5 Nucleotide Sequence (SEQ ID NO:9)
AACAAAGCCATCCCCGGAGGAAAGGAGACGTCGGTCACCATTGACATCCAGCACCCTCCACTGGTCAACCTCTCGG

TGGAGCCACAGCCAGTGCTGGAGGACAACGTCGTCACTTTCCACTGCTCTGCAAAGGCCAACCCAGCTGTCACCCA

GTACAGGTGGGCCAAGCGGGGCCAGATCATCAAGGAGGCATCTGGAGAGGTGTACAGGACCACAGTGGACTACACG

TACTTCTCAGAGCCCGTCTCCTGTGAGGTGACCAAAGCCCTGGGCAGCACCAACCTCAGCCGCACGGTTGACGTCT

ACTTTGGGCCCCGGATGACCACAGAACCCCAATCCTTGCTCGTGGATCTGGGCTCTGATGCCATCTTAAGCTGCGC

CTGGACCGGCAACCCATCCCTGACCATCGTCTGGATGAAGCGGGGCTCCGGAGTGGTCCTGAGCAATGAGAAGACC

CTGACCCTCAAATCCGTGCGCCAGGAGGACGCGGGCAAGTACGTGTGCCGGGCTGTGGTGCCCCGTGTGGGAGCCG

GGGAGAGAGAGGTGACCCTGACCGTCAATGGACCCCCCATCATCTCCAGCACCCAGACCCAGCACGCCCTCCACGG

CGAGAAGGGCCAGATCAAGTGCTTCATCCGGAGCACGCCGCCGCCGGACCGCATCGCCTGGTCCTGGAAGGAGAAC

GTTCTGGAGTCGGGCACATCGGGGCGCTATACGGTGGAGACCATCAGCACCGAGGAGGGCGTCATCTCCACCCTGA

CCATCAGCAACATCGTGCGGGCCGACTTCCAGACCATCTACAACTGCACGGCCTGGAACAGCTTCGGCTCCGACAC

TGAGATCATCCGGCTCAAGGAGCAAGGTTCGGAAATGAAGTCGGGAGCCGGGCTGGAAGCAGAGTCTGTGCCGATG

GCCGTCATCATTGGGGTGGCCGTAGGAGCTGGTGTGGCCTTCCTCGTCCTTATGGCAACCATCGTGGCGTTCTGCT

GTGCCCGTTCCCAGAGAAATCTCAAAGGTGTTGTGTCAGCCAAAAATGATATCCGAGTGGAAATTGTCCACAAGGA

ACCAGCCTCTGGTCGGGAGGGTGAGGAGCACTCCACCATCAAGCAGCTGATGATGGACCGGGGTGAATTCCAGCAA

GACTCAGTCCTGAAACAGCTGGAGGTCCTCAAAGAAGAGGAGAAAGAGTTTCAGAACCTGAAGGACCCCACCAATG

GCTACTACAGCGTCAACACCTTCAAAGAGCACCACTCAACCCCGACCATCTCCCTCTCCAGCTGCCAGCCCGACCT

GCGTCCTGCGGGCAAGCAGCGTGTGCCCACAGGCATGTCCTTCACCAACATCTACAGCACCCTGAGCGGCCAGGGC

TABLE 5A-continued

NOV5 Nucleotide Sequence

CGCCTCTACGACTACGGGCAGCGGTTTGTGCTGGGCATGGGCAGCTCGTCCATCGAGCTTTGTGAGCGGGAGTTCC

AGAGAGGCTCCCTCAGCGACAGCAGCTCCTTCCTGGACACGCAGTGTGACAGCAGCGTCAGCAGCAGCGGCAAGCA

GGATGGCTATGTGCAGTTCGACAAGGCCAGCAAGGCTTCTGCTTCCTCCTCCCACCACTCCCAGTCCTCGTCCCAG

AACTCTGACCCCAGTCGACCCCTGCAGCGGCGGATGCAGACTCACGTCTAAGGATCACACACCGCGGGTGGGGACG

GGCCAGGGAAGAGGTCAGGGCACGTTCTGGTTGTCCAGGGACTGTGGGGTACTTTACAGAGGACACCAGAATGGCC

CACTTCCAGGACAGCCTCCCAGCGCCTCTGCCACTGCCTTCCTTCGAAGCTCTGATCA

The NOV5 of the invention maps to chromosome 11.

In a search of sequence databases, it was found, for example, that the NOV5 nucleic acid sequence of this invention has 564 of 919 bases (61%) identical to a gb:GEN-BANK-ID:AK022708|acc:AK022708.1 mRNA from *Homo sapiens* (*Homo sapiens* cDNA FLJ12646 fis, clone NT2RM4001987, weakly similar to NEURAL CELL ADHESION MOLECULE 1, LARGE ISOFORM PRECURSOR).

The NOV5 polypeptide (SEQ ID NO:10) encoded by SEQ ID NO:9 is 548 amino acid residues in length and is presented using the one-letter amino acid code in Table 5B. The SignalP, Psort and/or Hydropathy results predict that NOV5 has no known signal peptide and is likely to be localized in the plasma membrane with a certainty of 0.7000. In alternative embodiments, a NOV5 polypeptide is located to the endoplasmic reticulum membrane with a certainty of 0.2000, or the mitochondrial inner membrane with a certainty of 0.1000.

TABLE 5B

Encoded NOV5 Protein Sequence (SEQ ID NO:10)
NKAIPGGKETSVTIDIQHPPLVNLSVEPQPVLEDNVVTFHCSAKANPAVTQYRWAKRGQIIKEASGEVYRTTVDY

TYFSEPVSCEVTKALGSTNLSRTVDVYFGPRMTTEPQSLLVDLGSDAILSCAWTGNPSLTIVWMKRGSGVVLSNE

KTLTLKSVRQEDAGKYVCRAVVPRVGAGEREVTLTVNGPPIISSTQTQHALHGEKGQIKCFIRSTPPPDRIAWSW

KENVLESGTSGRYTVETISTEEGVISTLTISNIVRADFQTIYNCTAWNSFGSDTEIIRLKEQGSEMKSGAGLEAE

SVPMAVIIGVAVGAGVAFLVLMATIVAFCCARSQRNLKGVVSAKNDIRVEIVHKEPASGREGEEHSTIKQLMMDR

GEFQQDSVLKQLEVLKEEEKEFQNLKDPTNGYYSVNTFKEHHSTPTISLSSCQPDLRPAGKQRVPTGMSFTNIYS

TLSGQGRLYDYGQRFVLGMGSSSIELCEREFQRGSLSDSSSFLDTQCDSSVSSSGKQDGYVQFDKASKASASSSH

HSQSSSQNSDPSRPLQRRMQTHV

The full amino acid sequence of the disclosed protein of the invention has 244 of 570 amino acid residues (42%) identical to, and 334 of 570 amino acid residues (58%) similar to, the 571 amino acid residue ptnr:TREMBLNEW-ACC:BAB14192 protein from *Homo sapiens* (Human) (cDNA FLJ12646 FIS, CLONE NT2RM4001987, WEAKLY SIMILAR TO NEURAL CELL ADHESION MOLECULE 1, LARGE ISOFORM PRECURSOR).

The amino acid sequence of NOV5 has high homology to other proteins as shown in Table 5C.

TABLE 5C

NOV5 BLASTP Results

| Gene Index/ Identifier | Protein/Organism | Length of aa | Identity (%) | Positives (%) | Expect Value |
|---|---|---|---|---|---|
| Q96JG0 | KIAA1867 PROTEIN - *Homo sapiens* (Human) | 779 | 546/548 (99%) | 546/548 (99%) | 1.6e−292 |
| Q9H9N1 | NT2RM4001987 PROTEIN - *Homo sapiens* (Human) | 571 | 244/570 (42%) | 334/570 (58%) | 5.3e−104 |
| Q96J84 | NEPH1 - *Homo sapiens* (Human) | 605 | 198/386 (51%) | 256/386 (66%) | 9.2e−100 |
| Q9NVA5 | NT2RP4001372 PROTEIN - *Homo sapiens* (Human) | 410 | 169/410 (41%) | 236/410 (57%) | 4.2e−63 |
| Q923L4 | NEPH1 - *Mus musculus* (Mouse) | 392 | 90/166 (54%) | 113/166 (68%) | 2.4e−46 |

A multiple sequence alignment is given in Table 5D in a ClustalW analysis comparing NOV5 with related protein sequences disclosed in Table 5C.

TABLE 5E. CLUSTALW ANALYSIS OF NOV5

1. SEQ ID NO.: 10   NOV5
2. SEQ ID NO.: 108  Q96JG0
3. SEQ ID NO.: 109  Q9H9N1
4. SEQ ID NO.: 110  Q96J84
5. SEQ ID NO.: 111  Q9NVA5
6. SEQ ID NO.: 112  Q923L4

```
                 10        20        30        40        50        60
        ....|....|....|....|....|....|....|....|....|....|....|....|
NOV5    ------------------------------------------------------------   1
Q96JG0  GMKPFQLDLLFVCFFLFSQELGLQKRGCCLVLGYMAKDKFRRMNEGQVYSFSQQPQDQVV  60
Q9H9N1  ------------------------------------------------------------   1
```

|         | 101 | 102 |
|---------|-----|-----|

```
Q96J84   ----------------------------------------------------------  1
Q9NVA5   ----------------------------------------------------------  1
Q923L4   ----------------------------------------------------------  1

70        80        90       100       110       120
              ....|....|....|....|....|....|....|....|....|....|....|....|
NOV5     ----------------------------------------------------------    1
Q96JG0   VSGQPVTLLCAIPEYDGFVLWIKDGLALGVGRDLSSYPQYLVVGNHLSGEHHLKILRAEL  120
Q9H9N1   ----------------------------------------------------------    1
Q96J84   ----------------------------------------------------------    1
Q9NVA5   ----------------------------------------------------------    1
Q923L4   ----------------------------------------------------------    1

130       140       150       160       170       180
              ....|....|....|....|....|....|....|....|....|....|....|....|
NOV5     ----------------------------------------------------------    1
Q96JG0   QDDAVYECQAIQAAIRSRPARLTVLVPPDDPVILGGPVISLRAGDPLNLTCHADNAKPAA  180
Q9H9N1   ----------------------------------------------------------    1
Q96J84   ----------------------------------------------------------    1
Q9NVA5   ----------------------------------------------------------    1
Q923L4   ----------------------------------------------------------    1

190       200       210       220       230       240
              ....|....|....|....|....|....|....|....|....|....|....|....|
NOV5     ------------------------------------------------NKAIPGGKE      9
Q96JG0   SIIWLRKGEVINGATYSKTLLRDGKRESIVSTLFISPGDVENGQSIVCRATNKAIPGGKE  240
Q9H9N1   -------------------------------------------------MNEAIPSGKE   10
Q96J84   ----------------------------------------------------------    1
Q9NVA5   ----------------------------------------------------------    1
Q923L4   ----------------------------------------------------------    1

250       260       270       280       290       300
              ....|....|....|....|....|....|....|....|....|....|....|....|
NOV5     TSVTIDIQHPPLVNLSVEPQPVLEDNVVTFHCSAKANPAVTQYRWAKRGQIIKEASGEVY   69
Q96JG0   TSVTIDIQHPPLVNLSVEPQPVLEDNVVTFHCSAKANPAVTQYRWAKRGQIIKEASGEVY  300
Q9H9N1   TSIELDVHHPPTVTLSIEPQTVQEGERVVFTCQATANPEILGYRWAKGGFLIEDAHESRY   70
Q96J84   ----------------------------------------------------------    1
Q9NVA5   ----------------------------------------------------------    1
Q923L4   ----------------------------------------------------------    1

310       320       330       340       350       360
              ....|....|....|....|....|....|....|....|....|....|....|....|
NOV5     RTTVDYTYFSEPVSCEVTKALGSTNLSRTVDVYFGPRMTTEPQSLLVDLGSDAILSCAWT  129
Q96JG0   RTTVDYTYFSEPVSCEVTNALGSTNLSRTVDVYFGPRMTTEPQSLLVDLGSDAIFSCAWT  360
Q9H9N1   ETNVDYSFFTEPVSCEVHNKVGSTNVSTLVNVHFAPRIVVDPKPTTTDIGSDVTLTCVWV  130
Q96J84   ----------------------------------------------------------    1
Q9NVA5   ----------------------------------------------------------    1
Q923L4   ----------------------------------------------------------    1

370       380       390       400       410       420
              ....|....|....|....|....|....|....|....|....|....|....|....|
NOV5     GNPSLTIVWMK---------------RGSGVVLSNEKTLTLKSVRQEDAGKYVCRAVVP  173
Q96JG0   GNPSLTIVWMK---------------RGSGVVLSNEKTLTLKSVRQEDAGKYVCRAVVP  404
Q9H9N1   GNPPLTLTWTKKDSNMGPRPPGSPPEAALSAQVLSNSNQLLLKSVQADAGTYTCRAIVP  190
Q96J84   ------------------------------MLSLLVWILTLSDIFSQGTQTRFSQEPADQ  30
Q9NVA5   -------------------------------MVLSNSNQLLLKSVTQADAGTYTCRAIVP  29
```

```
Q923L4   ------------------------MWAPHLVVAYLIFVILALALPGTQTRFSQEPADQ  34

430       440       450       460       470       480
         ....|....|....|....|....|....|....|....|....|....|....|....|
NOV5     RVGAGEREVT--LTVNGPPIISSTQTQHALHGEKGQIKCFIRSTPPPDRIAWSWKENVLE  231
Q96JG0   RVGAGEREVT--LTVNGPPIISSTQTQHALHGEKGQIKCFIRSTPPPDRIAWSWKENVLE  462
Q9H9N1   RIGVAEREVP--LYVNGPPIISSEAVQYAVRGDGGKVECFIGSTPPPDRIAWAWKENFLE  248
Q96J84   TVVAGQRAVLPCVLLNYSGIVQWTKDGLAL-GMGQGLKAWPRYRVVGSADAGQYNLEITD   89
Q9NVA5   RIGVAEREVP--LYVNGPPIISSEAVQYAVRGDGGKVECFIGSTPPPDRIAWAWKENFLE   87
Q923L4   TVVAGQRAVLPCVLLNYSGIVQWTKDGLAL-GMGQGLKAWPRYRVVGSADAGQYNLEITD   93

490       500       510       520       530       540
         ....|....|....|....|....|....|....|....|....|....|....|....|
NOV5     SGTSGRYTVETISTEEGVISTLTISNIVRADFQTIYNCTAWNSFGSDTEIIRLKEQGSEM  291
Q96JG0   SGTSGRYTVETISTEEGVISTLTISNIVRADFQTIYNCTAWNSFGSDTEIIRLKEQGSEM  522
Q9H9N1   VGTLERYTVERTNSGSGVLSTETINNVMEADFQTHYNCTAWNSFGPCTAI--IQLE----  302
Q96J84   AELSDDASYECQATEAALRSRRAKLTVLIPPEDTRIDGGPVILLQAGTPHN-LTCR----  144
Q9NVA5   VGTLERYTVERTNSGSGVLSTLTINNVMEADFQTHYNCTAWNSFGPCTAI--IQLE----  141
Q923L4   AELSDDASYECQATEAALRSRRAKLTVLIPPEETRIDGGPVILLQAGTPYN-LTCR----  148

550       560       570       580       590       600
         ....|....|....|....|....|....|....|....|....|....|....|....|
NOV5     KSGAGLEAESVPMAVIIGVAVGAGVAFLVLMATIVAFCCARSQRNLKGVVSAKNDI-RVE  350
Q96JG0   KSGAGLEAESVPMAVIIGVAVGAGVAFLVLMATIVAFCCARSQRNLKGVVSAKNDI-RVE  581
Q9H9N1   ------EREVLPVGIIAGATIGASILLFFFIALVFFLYRRRKGSRKDVTLRKLDI-KVE  355
Q96J84   ------AFNAKPAATIIWFRDGTQQEGAVASTELLKDGKRETTVSQLLINPTDLDIGRVF  198
Q9NVA5   ------EREVLPVGIIAGATIGASILLIFFFIALVFFLYRRRKGSRKDVTLRKLDI-KVE  194
Q923L4   ------AFNAKPAATIIWFRDGTQQEGAVTSTELLKDGKRETTISQLLIEPTDLDIGRVF  202

610       620       630       640       650       660
         ....|....|....|....|....|....|....|....|....|....|....|....|
NOV5     IVHKEPASGREGEE------HSTIKQLMMDRGEFQDSVLK-Q---LEVLKEEEKEFQNL  400
Q96JG0   IVHKEPASGREGEE------HSTIKQLMMDRGEFQDSVLK-Q---LEVLKEEEKEFQNL  631
Q9H9N1   TVNREPLTMHSDREDDTASVSTATRVMKAIYSSFKDDVDLKQD---LRCDTIDTREEYEM  412
Q96J84   TCRSMNEAIPSGKE---TSIELDVHHPPTVTLSIEPQTVQEGERVVFTCQATANPEILGY  255
Q9NVA5   TVNREPLTMHSDREDDTASVSTATRVMKAIYSSFKDDVDLKQD---LRCDTIDTREEYEM  251
Q923L4   TCRSMNEAIPNGKE---TSIELDVHHPPTVTLSIEPQTVLEGERVIFTCQATANPEILGY  259

670       680       690       700       710       720
         ....|....|....|....|....|....|....|....|....|....|....|....|
NOV5     KDPTNGYYSVNTFKEHHSTPTISLSSCQPDLRPAGKQRVPTGMSFTNIYSTLSGQGRLYD  460
Q96JG0   KDPTNGYYSVNTFKEHHSTPTISLSSCQPDLRPAGKQRVPTGMSFTNIYSTLSGQGRLYD  691
Q9H9N1   KDPTNGYYNVRAHEDRPSSRAVLYADYRAPGPARFDGRPSSRLSHSSGYAQLNT----YS  468
Q96J84   RWAKGGFLIEDAHESR-YETNVDYSFFTEPVSCEVHNKVG-----STNVSTLVN----VH  305
Q9NVA5   KDPTNGYYNVRAHEDRPSSRAVLYADYRAPGPARFDGRPSSRLSHSSGYAQLNT----YS  307
Q923L4   RWAKGGFLIEDAHESR-YETNVDYSFETEPVSCEVYNKVG-----STNVSTLVN----VH  309

730       740       750       760       770       780
         ....|....|....|....|....|....|....|....|....|....|....|....|
NOV5     YGQRFVLGMGSS----SIELCEREFQRGSLSD-------------SSSFLDTQCDSSVSS  503
Q96JG0   YGQRFVLGMGSS----SIELCEREFQRGSLSD-------------SSSFLDTQCDSSVSS  734
Q9H9N1   RGPASDYGPEPTPPGPAAPAGTDTTSQLSYENYEKFNSHPFPGAAGYPTYRLGYPQAPPS  528
Q96J84   FAPRIVVDPKPT----TTDIGSDVTLTCVWV-------------GNPPLTLTWTKKDSN  347
Q9NVA5   RGPASDYGPEPTPPGPAAPAGTDTTSQLSYENYEKFNSHPFPGAAGYPTYRLGYPQAPPS  367
Q923L4   FAPRIVVYPKPT----TTDIGSDVTLTCVWV-------------GNPPLTLTWTKKDSN  351

790       800       810       820       830       840
         ....|....|....|....|....|....|....|....|....|....|....|....|
```

```
                                           105                                                    106
NOV5     SGKQDGYVQEDKASKASASS--SHHS------------------QSSSQNSDPSRPLQR  542
Q96JG0   SGKQDGYVQEDKASKASASS--SHHS------------------QSSSQNSDPSRPLQR  773
Q9H9N1   GLERTPYEAYDPIGKYATATRFSYTS------------------QHSDYGQRFQQ----  565
Q96J84   MVLSNSNQLLLKSVTQADAG--TYTCRAIVPRIGVAEREVPLYVNGPPIISSEAVQYAVR  405
Q9NVA5   GLERTPYEAYDPIGKYATATRFSYTS------------------QHSDYGQRFQQ----  404
Q923L4   MVLSNSNQLLLKSVTQADAG--TYTA------------------GPSCLGSEWLS----  386

850       860       870       880       890       900
              ....|....|....|....|....|....|....|....|....|....|....|....|
NOV5     ------------------------------------RMQTHV-----------------  548
Q96JG0   ------------------------------------RMQTHV-----------------  779
Q9H9N1   ------------------------------------RMQTHV-----------------  571
Q96J84   GDGGKVECFIGSTPPPDRIAWAWKENFLEVGTLERYTVERTNSGSGVLSTLTINNVMEAD  465
Q9NVA5   ------------------------------------RMQTHV-----------------  410
Q923L4   ---------------------------------ERYRFM-------------------  392

910       920       930       940       950       960
              ....|....|....|....|....|....|....|....|....|....|....|....|
NOV5     ------------------------------------------------------------  548
Q96JG0   ------------------------------------------------------------  779
Q9H9N1   ------------------------------------------------------------  571
Q96J84   FQTHYNCTAWNSFGPGTAIIQLEEREVLPVGIIAGATIGASILLIFFFIALVFFLYRRRK  525
Q9NVA5   ------------------------------------------------------------  410
Q923L4   ------------------------------------------------------------  392

970       980       990      1000      1010      1020
              ....|....|....|....|....|....|....|....|....|....|....|....|
NOV5     ------------------------------------------------------------  548
Q96JG0   ------------------------------------------------------------  779
Q9H9N1   ------------------------------------------------------------  571
Q96J84   GSRKDVTLRKLDIKVETVNREPLTMHSDREDDTASVSTATRVMKAIYSSFKDDVDLKQDL  585
Q9NVA5   ------------------------------------------------------------  410
Q923L4   ------------------------------------------------------------  392

1030      1040
              ....|....|....|....|
NOV5     --------------------  548
Q96JG0   --------------------  779
Q9H9N1   --------------------  571
Q96J84   RCDTIERPRIRGRLNTSYSD  605
Q9NVA5   --------------------  410
Q923L4   --------------------  392
```

Additional BLAST results are shown in Table 5E.

TABLE 5E

Patp BLASTP Analysis for NOV5

| Sequences producing High-scoring Segment Pairs | Protein/Organism | Length (aa) | Identity (%) | Positive (%) | E Value |
|---|---|---|---|---|---|
| patp: AAU12278 | Human PRO4502 polypeptide sequence | 245 | 245/245 (100%) | 245/245 (100%) | 8.6e−127 |
| patp: AAB37996 | Human secreted protein encoded by gene 13 clone HIBEU15 | 257 | 238/258 (92%) | 238/258 (92%) | 5.4e−118 |
| patp: AAE07070 | Human gene 20 encoded secreted protein HDTJG33 | 712 | 244/570 (42%) | 73/126 (57%) | 4.1e−104 |
| patp: AAB94206 | Human protein sequence | 571 | 244/570 (42%) | 334/570 (58%) | 4.1e−104 |
| patp: AAU17986 | Human immunoglobulin polypeptide | 550 | 187/371 (50%) | 242/371 (65%) | 2.3e−94 |

Domain results for NOV5 were collected from the Pfam database, and then identified by the Interpro domain accession number. The results are listed in Table 5F with the statistics and domain description. These results indicate that the NOV5 polypeptide has properties similar to those of other proteins known to contain these domains.

TABLE 5F

DOMAIN ANALYSIS OF NOV5

| PSSMs Producing Significant Alignments | Score (bits) | E Value |
|---|---|---|
| Immunoglobulin (Ig): domain 2 of 3, from 119 to 170 | 33.6 | 7.5e-09 |

```
(SEQ ID NO:113)     GesvtLtCsvsgfgpp.p.vtWlrngk.......lslti.svtpeDs
                    |+++ |+|   +  ++++ ++  | + + +
+++ ++++++++++|+
  NOV5          (SEQ ID NO:350) GSDAILSCAWT--
GNPsLtIVWMKRGSgvvlsneKTLTLkSVRQEDA gGtYtCvv
                              | | |++
                    -GKYVCRA
```

The neural cell adhesion molecule disclosed in this invention is expressed in at least the following tissues: amygdala, brain, placenta, spinal chord. In addition, the sequence is predicted to be expressed in the following tissues because of the expression pattern of (GENBANK-ID: gb:GENBANK-ID:AK022708|acc:AK022708.1) a closely related *Homo sapiens* cDNA FLJ12646 fis, clone NT2RM4001987, weakly similar to NEURAL CELL ADHESION MOLECULE 1, LARGE ISOFORM PRECURSOR homolog in species *Homo sapiens*: kidney.

The protein similarity information, expression pattern, and map location for the NOV5 protein and nucleic acid disclosed herein suggest that this protein may have important structural and/or physiological functions characteristic of the cell adhesion molecule family. Therefore, the NOV5 nucleic acids and proteins of the invention are useful in potential diagnostic and therapeutic applications and as a research tool. For example, the compositions of the present invention will have efficacy for treatment of patients suffering from: Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, fertility, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, and other diseases, disorders and conditions of the like.

The novel NOV5 nucleic acids and polypeptides of the invention, or fragments thereof, are useful in diagnostic applications, wherein the presence or amount of the nucleic acid or the protein are to be assessed. These materials are further useful in the generation of antibodies that bind immunospecifically to the novel substances of the invention for use in therapeutic or diagnostic methods. These antibodies may be generated according to methods known to one ordinarily skilled in the art, using prediction from hydrophobicity charts, as described in the "Anti-NOVX Antibodies" section below.

The disclosed NOV5 protein of the invention has multiple hydrophilic regions, each of which can be used as an immunogen. The NOV5 protein also has value in the development of a powerful assay system for functional analysis of various human disorders, which will help in understanding of pathology of the disease and development of new drug targets for various disorders.

Neural cell adhesion molecules (NCAM) are members of the cell adhesion molecule family with homology to the immunoglobulin protein superfamily. They play critical roles in neuronal outgrowth, differentiation and development, as well as oligodendrocyte maturation and myelination, probably by modulating cell—cell interactions. NCAMs can also reorganize the extra-cellular space and cause disturbances that drive the development of brain pathology in conditions such as Alzheimer's disease and multiple sclerosis. Disease-causing mutations and gene knock-out studies further substantiate that neural cell adhesion molecules are required for axon guidance, brain plasticity, long term potentiation, learning and neuron regeneration. Therefore, these proteins are essential for brain function and may be used as therapeutic targets in that context.

NOV6

The NOV6 nucleic acid (SEQ ID NO:11) (alternatively referred to as CG55916-01) of 2405 nucleotides encodes a novel phospholipase C delta-like protein and is shown in Table 6A. An open reading frame for the mature protein was identified beginning with a ATG initiation codon at nucleotides 153–155 and ending with a TGA codon at nucleotides 2361–2363. Putative untranslated regions upstream from the start codon and downstream from the termination codon are underlined in Table 6A. The start and stop codons are in bold letters.

TABLE 6A

NOV6 Nucleotide Sequence (SEQ ID NO:11)
GCGGCCGCTGGAGGCGTTGCCGCCGCCCGCCCGAGGAGCCCCCGGTGGCCGCCCAGGTCGCAGCCCAAGT

CGCGGCGCCGGTCGCTCTCCCGTCCCCGCCGACTCCCTCCGATGGCGGCACCAAGAGGCCCGGGCTGCGG

GCGCTGAAGAAGATGGGCCTGACGGAGGACGAGGACGTGCGCGCCATGCTGCGGGGCTCCCGGCTCCGCA

AGATCCGCTCGCGCACGTGGCACAAGGAGCGGCTGTACCGGCTGCAGGAGGACGGCCTGAGCGTGTGGTT

CCAGCGGCGCATCCCGCGTGCGCCATCGCAGCACATCTTCTTCGTGCAGCACATCGAGGCGGTCCGCGAG

GGCCACCAGTCCGAGGGCCTGCGGCGCTTCGGGGGTGCCTTCGCGCCAGCGCGCTGCCTCACCATCGCCT

TCAAGGGCCGCCGCAAGAACCTGGACCTGGCGGCGCCCACGGCTGAGGAAGCGCAGCGCTGGGTGCGCGG

TCTGACCAAGCTCCGCGCGCGCCTGGACGCCATGAGCCAGCGCGAGCGGCTAGACCAATGGATCCACTCC

TATCTGCACCGGGCTGACTCCAACCAGGACAGCAAGATGAGCTTCAAGGAGATCAAGAGCCTGCTGAGAA

TGGTCAACGTGGACATGAACGACATGTACGCCTACCTCCTCTTCAAGGAGTGTGACCACTCCAACAACGA

CCGTCTAGAGGGGCTGAGATCGAGGAGTTCCTGCGGCGGCTGCTGAAGCGGCCGGAGCTGGAGGAGATC

TTCCATCAGTACTCGGGCGAGGACCGCGTGCTGAGTGCCCCTGAGCTGCTGGAGTTCCTGGAGGACCAGG

GCGAGGAGGGCGCCACACTGGCCCGCGCCCAGCAGCTCATTCAGACCTATGAGCTCAACGAGACAGCCCC

TGCAGCCAAGCAGCATGAGCTGATGACACTGGATGGCTTCATGATGTACCTGTTGTCGCCGGAGGGGCT

GCCTTGGACAACACCCACACGTGTGTGTTCCAGGACATGAACCAGCCCCTTGCCCACTACTTCATCTCTT

CCTCCCACAACACCTATCTGACTGACTCCCAGATCGGGGGGCCCAGCAGCACCGAGGCCTATGTTAGGGC

CTTTGCCCAGGGATGCCGCTGCGTGGAGCTGGACTGCTGGGAGGGGCCAGGAGGGGAGCCCGTCATCTAT

CATGGCCATACCCTCACCTCCAAGATTCTCTTCCGGGACGTGGTCCAAGCCGTGCGCGACCATGCCTTCA

CGGTGAGCCCTTACCCTGTCATCCTATCCCTGGAGAACCACTGCGGGCTGGAGCAGCAGGCTGCCATGGC

CCGCCACCTCTGCACCATCCTGGGGGACATGCTGGTGACACAGGCGCTGGACTCCCCAAATCCCGAGGAG

CTGCCATCCCCAGAGCAGCTGAAGGCCGGGTCCTGGTGAAGGGAAAGAAGTTGCCCGCTGCTCGGAGCG

AGGATGGCCGGGCTCTGTCGGATCGGGAGGAGGAGGAGGAGGATGACGAGGAGGAAGAAGAGGAGGTGGA

GGCTGCAGCGCAGAGGCAGATCTCCCCGGAGCTGTCGGCCCTGGCTGTGTACTGCCACGCCACCCGCCTG

CGACCCGACACATCACCTGGAGGACTAGGAAGCAGCCAGGTGAAGAGGGGAGAGCGCTTTCCAGACAGGA

GGAACAGGTTGTTGAAGGCCTGGGGGAACAGCTTTGTCAGGCACAATGCCCGCCAGCTGACCCGCGTGTA

CCCGCTGGGGCTGCGGATGAACTCAGCCAACTACAGTCCCCAGGAGATGTGGAACTCGGGCTGTCAGCTG

GTGGCCTTGAACTTCCAGACGCCAGGCTACGAGATGGACCTCAATGCCGGGCGCTTCCTAGTCAATGGGC

AGTGTGGCTACGTCCTAAAACCTGCCTGCCTGCGGCAACCTGACTCGACCTTTGACCCCGAGTACCCAGG

TABLE 6A-continued

NOV6 Nucleotide Sequence

ACCTCCCAGAACCACTCTCAGCATCCAGGTGCTGACTGCACAGCAGCTGCCCAAGCTGAATGCCGAGAAG

CCACACTCCATTGTGGACCCCCTGGTGCGCATTGAGATCCATGGGGTGCCCGCAGACTGTGCCCGGCAGG

AGACTGACTACGTGCTCAACAATGGCTTCAACCCCCGCTGGGGGCAGACCCTGCAGTTCCAGCTGCGGGC

TCCGGAGCTGGCACTGGTCCGGTTTGTGGTGGAAGATTATGACGCCACCTCCCCCAATGACTTTGTGGGC

CAGTTTACACTGCCTCTTAGCAGCCTAAAGCAAGGGTACCGCCACATACACCTGCTTTCCAAGGACGGGG

CCTCACTGTCACCAGCCACGCTCTTCATCCAAATCCGCATCCAGCGCTCCTGAGGGCCCACCTCACTCGC

CTTGGGGTTCTGCGAGTGCCAGTCC

The NOV6 of the invention maps to chromosomes 17.

In a search of sequence databases, it was found, for example, that the NOV6 nucleic acid sequence of this invention has 956 of 1425 bases (67%) identical to a acc:U09117.1 mRNA from human (Human phospholipase C delta 1 mRNA, complete cds—*Homo sapiens*, 2627 bp).

The NOV6 polypeptide (SEQ ID NO:12) encoded by SEQ ID NO:11 is 736 amino acid residues in length and is presented using the one-letter amino acid code in Table 6B. The SignalP, Psort and/or Hydropathy results predict that NOV6 has no known signal peptide and is likely to be localized in the mitochondrial matrix space with a certainty of 0.3600. In alternative embodiments, a NOV6 polypeptide is located to the microbody (peroxisome) with a certainty of 0.3000, or the lysosome (lumen) with a certainty of 0.1626.

TABLE 6B

Encoded NOV6 Protein Sequence (SEQ ID NO:12)
MGLTEDEDVRAMLRGSRLRKIRSRTWHKERLYRLQEDGLSVWFQRRIPRAPSQHIFFVQHIEAVREGHQSEGLRR

FGGAFAPARCLTIAFKGRRKNLDLAAPTAEEAQRWVRGLTKLRARLDAMSQRERLDQWIHSYLHRADSNQDSKMS

FKEIKSLLRMVNVDMNDMYAYLLFKECDHSNNDRLEGAEIEEFLRRLLKRPELEEIFHQYSGEDRVLSAPELLEF

LEDQGEEGATLARAQQLIQTYELNETAPAAKQHELMTLDGFMMYLLSPEGAALDNTHTCVFQDMNQPLAHYFISS

SHNTYLTDSQIGGPSSTEAYVRAFAQGCRCVELDCWEGPGGEPVIYHGHTLTSKILFRDVVQAVRDHAFTVSPYP

VILSLENHCGLEQQAAMARHLCTILGDMLVTQALDSPNPEELPSPEQLKGRVLVKGKKLPAARSEDGRALSDREE

EEEDDEEEEEEVEAAAQRQISPELSALAVYCHATRLRPDTSPGGLGSSQVKRGERFPDRRNRLLKAWGNSFVRHN

ARQLTRVYPLGLRMNSANYSPQEMWNSGCQLVALNFQTPGYEMDLNAGRFLVNGQCGYVLKPACLRQPDSTFDPE

YPGPPRTTLSIQVLTAQQLPKLNAEKPHSIVDPLVRIEIHGVPADCARQETDYVLNNGFNPRWGQTLQFQLRAPE

LALVRFVVEDYDATSPNDFVGQFTLPLSSLKQGYRHIHLLSKDGASLSPATLFIQIRIQRS

The full amino acid sequence of the disclosed protein of the invention has 388 of 744 amino acid residues (52%) identical to, and 511 of 744 amino acid residues (68%) similar to, the 756 amino acid residue ptnr:SPTREMBL-ACC:Q9Z1B4 from mouse (PHOSPHOLIPASE C-DELTA1).

The amino acid sequence of NOV6 has high homology to other proteins as shown in Table 6C.

TABLE 6C

NOV6 BLASTP Results

| Gene Index/ Identifier | Protein/Organism | Length of aa | Identity (%) | Positives (%) | Expect Value |
|---|---|---|---|---|---|
| CAC88658 | SEQUENCE 1 FROM PATENT WO0166764 - *Homo sapiens* (Human) | 736 | 707/736 (96%) | 713/736 (96%) | 0.0 |
| Q96FL6 | SIMILAR TO PHOSPHOLIPASE C, DELTA - *Homo sapiens* (Human) | 2998 | 584/613 (95%) | 590/613 (96%) | 3.1e−312 |
| Q60450 | PHOSPHOLIPASE C-DELTA1 - *Cricetulus griseus* (Chinese hamster) | 1975 | 384/744 (51%) | 520/744 (69%) | 8.0e−204 |
| Q9Z1B4 | PHOSPHOLIPASE C DELTA-1 - *Mus musculus* (Mouse) | 1941 | 388/744 (52%) | 511/744 (68%) | 3.2e−200 |
| P51178 | 1-phosphatidylinositol - 4,5-bisphosphate phosphodiesterase delta 1 (EC 3.1.4.11) (PLC-delta-1) (Phospholipase C-delta-1) (PLC-III) - *Homo sapiens* (Human) | 1937 | 381/744 (51%) | 509/744 (68%) | 8.5e−200 |

A multiple sequence alignment is given in Table 6D in a ClustalW analysis comparing NOV6 with related protein sequences disclosed in Table 6C.

TABLE 6D. CLUSTALW ANALYSIS OF NOV6

1. SEQ ID NO.: 12 NOV6
2. SEQ ID NO.: 114 CAC88658
3. SEQ ID NO.: 115 Q96FL6
4. SEQ ID NO.: 116 Q60450
5. SEQ ID NO.: 117 Q9Z1B4
6. SEQ ID NO.: 118 P51178

```
                 10        20        30        40        50        60
            ....|....|....|....|....|....|....|....|....|....|....|....|
NOV6        ----------MGLTEDEDVRAMLRGSRLRKIRSRIWHKERLYRLQEDGLSVWFQRR-IPR  49
CAC88658    ----------MGLTEDEDVRAMLRGSRLRKIRSRIWHKERLYRLQEDGLSVWFQRR-IPR  49
Q96FL6      ------------------------------------------------------------   1
Q60450      ----------GLQDDQDLQALLKGSQLLKVKSSWRRERFYKLQEDCKTIWQESRKVMR   49
Q9Z1B4      MDSGRDFLTLHGLQDDPDLQALLKGSQLLKVKSSWRRERFYKLQEDCKTIWQESRKVMR   60
P51178      MDSGRDFLTLHGLQDDEDLQALLKGSQLLKVKSSWRRERFYKLQEDCKTIWQESRKVMR   60

70        80        90       100       110       120
            ....|....|....|....|....|....|....|....|....|....|....|....|
NOV6        APSQHIFFVQHIEAVREGHQSEGLRRFGGAFAPARCLTIAFKGRRKNLDLAAPTAEEAQR 109
CAC88658    APSQHIFFVQHIEAVREGHQSEGLRRFGGAFAPARCLTIAFKGRRKNLDLAAPTAEEAQR 109
Q96FL6      ------------------------------------------------------------   1
Q60450      SPESQLFSTEDIQEVRMGHRTEGLEKFARDIPEDRCFSIVFKDQRNTLDLIAPSSADACH 109
Q9Z1B4      SPESQLFSTEDIQEVRMGHRTEGLEKFARDIPEDRCFSIVFKDQRNTLDLIAPSPADVCH 120
P51178      TPESQLFSTEDIQEVRMGHRTEGLEKFARDVPEDRCFSIVFKDQRNTLDLIAPSPADACH 120

130       140       150       160       170       180
            ....|....|....|....|....|....|....|....|....|....|....|....|
NOV6        WVRGLTKLRARLDAMSQRERLDQWIHSYLHRADSNQDSKMSFKEIKSLLRMVNVDMNDMY 169
CAC88658    WVRGLTKLRARLDAMSQRERLDHWIHSYLHRADSNQDSKMSFKEIKSLLRMVNVDMNDMY 169
Q96FL6      --------------MSQRERLDHWIHSYLHRADSNQDSKMSFKEIKSLLRMVNVDMNDMY  46
Q60450      WVQGLRKIIHHSGSMDQRQKLQHWIHSCLRKADKNKDNKMNFKELKDFLKELNIQVDDSY 169
Q9Z1B4      WVQGLRKIIDRSGSMDQRQKLQHWIHSCLRKADKNKDNKMNFKEVKDFLKELNVQVDDSY 180
P51178      WVLGLHKIIHHSGSMDQRQKLQHWIHSCLRKADKNKDNKMSFKELQNFLKELNIQVDDSY 180

190       200       210       220       230       240
            ....|....|....|....|....|....|....|....|....|....|....|....|
NOV6        AYLLFKECDHSNNDRLEGAEIEEFLRRLLKRPELEEIFHQYSGEDRVLSAPELEFLEDQ  229
CAC88658    AYLLFKECDHSNNDRLEGAEIEEFLRRLLKRPELEEIFHQYSGEDRVLSAPELEFLEDQ  229
Q96FL6      AYLLFKECDHSNNDRLEGAEIEEFLRRLLKRPELEEIFHQYSGEDRVLSAPELEFLEDQ  106
Q60450      ARKIFRECDHSQTDSLEDEEIETFYKMLTQRAEIDRVFAEAAGSAETLSVEKLVTFLQHQ 229
```

```
Q9Z1B4    ARKIFRECDHSQTDSLEDEEIETFYRMITQRAELDRAFAEAAGSAETLSVEKLVTFLQHQ 240
P51178    ARKIFRECDHSQTDSLEDEEIEAFYKMITQRVEIDRTFAEAAGPGETLSVDQLVTFLQHQ 240

250       260       270       280       290       300
         ....|....|....|....|....|....|....|....|....|....|....|....|
NOV6     -GEEGATLARAQQLIQTYELNETAPAAKQHELMTLDGFMMYLLSPEGAALDNTHTCVEQD 288
CAC88658 -GEEGATLARAQQLIQTYELNETA---KQHELMTLDGFMMYLLSPEGAALDNTHTCVEQD 285
Q96FL6   -GEEGATLARAQQLIQTYELNETA---KQHELMTLDGFMMYLLSPEGAALDNTHTCVEQD 162
Q60450   QREEAAGPALALSLIERYEPSETA---KAQRQMTKDGFLMYLLSADCSAFSLAHRRVYQD 286
Q9Z1B4   QREEAAGPALALSLIERYEPSETA---KAQRQMTKDGFLMYLLSADCNAFSLAHRRVYQD 297
P51178   QREEAAGPALALSLIERYEPSETT---KAQRQMTKDGFLMYLLSADCSAFSLAHRRVYQD 297

310       320       330       340       350       360
         ....|....|....|....|....|....|....|....|....|....|....|....|
NOV6     MNQPLAHYFISSSHNTYLTDSQIGGPSSTEAYVRAFAQGCRCVELDCWEGPGGEPVIYHG 348
CAC88658 MNQPLAHYFISSSHNTYLTDSQIGGPSSTEAYVRAFAQGCRCVELDCWEGPGGEPVIYHG 345
Q96FL6   MNQPLAHYFISSSHNTYLTDSQIGGPSSTEAYVRAFAQGCRCVELDCWEGPGGEPVIYHG 222
Q60450   MDQPLSHYLVSSSHNTYLLEDQLTGPSSTEAYIRALCKGCRCLELDCWDGPNQEPIIYHG 346
Q9Z1B4   MNQPLSHYLVSSSHNTYLLEDQLTGPSSTEAYIRALCKGCRCLELDCWDGPNQEPIIYHG 357
P51178   MGQPLSHYLVSSSHNTYLLEDQLAGPSSTEAYIRALCKGCRCLELDCWDGPNQEPIIYHG 357

370       380       390       400       410       420
         ....|....|....|....|....|....|....|....|....|....|....|....|
NOV6     HTLTSKILFRDVVQAVRDHAFTVSPYPVILSLENHCGLEQQAAMARHLCTILGDMLVTQA 408
CAC88658 HTLTSKILFRDVVQAVRDHAFTLSPYPVILSLENHCGLEQQAAMARHLCTILGDMLVTQA 405
Q96FL6   HTLTSKILFRDVVQAVRDHAFTLSPYPVILSLENHCGLEQQAAMARHLCTILGDMLVTQA 282
Q60450   YTFTSKILFYDVLRAIRDYAFKASPYPVILSLENHCSLEQQQVMARHLKAILGPMLLDQP 406
Q9Z1B4   YTFTSKILFCDVLRAIRDYAFKASPYPVILSLENHCSLEQQRVMAHHLRAILGPMLLDQP 417
P51178   YTFTSKILFCDVLRAIRDYAFKASPYPVILSLENHCTLEQQRVMARHLHAILGPMLLNRP 417

430       440       450       460       470       480
         ....|....|....|....|....|....|....|....|....|....|....|....|
NOV6     LDSPNPEELPSPEQLKGRVLVKGKKLP---AARSEDGRALSDREEEEEDDEEEEEVEAA 465
CAC88658 LDSPNPEELPSPEQLKGRVLVKGKKLP---AARSEDGRALSDREEEEEDDEEEEEVEAA 462
Q96FL6   LDSPNPEELPSPEQLKGRVLVKGKKLP---AARSEDGRALSDREEEEEDDEEEEEVEAA 339
Q60450   LDG-VTMSLPSPEQLKGKILLKGKKFGGLLPAGGENGPETTDVSDEDEAAEMEDEAVRSQ 465
Q9Z1B4   LDG-VTTSLPSPEQLKEKILLKGKKLGGLLPAGGENGPEATDVSDEDEAAEMEDEAVRSQ 476
P51178   LDG-VTNSLPSPEQLKGKILLKGKKLGGLLPPGGEGGPEATVVSDEDEAAEMEDEAVRSR 476

490       500       510       520       530       540
         ....|....|....|....|....|....|....|....|....|....|....|....|
NOV6     AQR-------QISPELSAIAVYCHATRLRPDTSPGGLGSSQVKRGERFPDRRNRLLKAWG 518
CAC88658 AQRRLAK---QISPELSAIAVYCHATRLR-TLHPAPNAPQPCQVSSLSERKAKKLIREAG 518
Q96FL6   AQRRLAK---QISPELSAIAVYCHATRLR-TLHPAPNAPQPCQVSSLSERKAKKLIREAG 395
Q60450   VQQKSKEDKLNVAPELSDMVIYCKSVHFGGFSNPSTSGQAFYEMASFSENRALRLLQESG 525
Q9Z1B4   VQHKPKEDKLKLVPELSDMVIYCKSVHFGGFSSPSTSGQAFYEMASFSESRALRLLQESG 536
P51178   VQHKPKEDKLRLAQELSDMVIYCKSVHFGGFSSPGTPGQAFYEMASFSENRALRLLQESG 536

550       560       570       580       590       600
         ....|....|....|....|....|....|....|....|....|....|....|....|
NOV6     NSFVRHNARQLTRVYPLGLRMNSANYSPQEMWNSGCQLVALNFQTPGYEMDLNAGRFLVN 578
CAC88658 NSFVRHNARQLTRVYPLGLRMNSANYSPQEMWNSGCQLVALNFQTPGYEMDLNAGRFLVN 578
Q96FL6   NSFVRHNARQLTRVYPLGLRMNSANYSPQEMWNSGCQLVALNFQTPGYEMDLNAGRFLVN 455
Q60450   NNFVRHNVSHLSRITYPAGRRTDSSNYSPVEMWNGGCQIVALNFQTPGPEMDVYLGRFQDN 585
Q9Z1B4   NSFVRHNVGHLSRIYPAGWRTDSSNYSPVEMWNGGCQIVALNFQTPGPEMDVYLGCFQDN 596
P51178   NGFVRHNVGHLSRIYPAGWRTDSSNYSPVEMWNGGCQIVALNFQTPGPEMDVYQDRFQDN 596

610       620       630       640       650       660
```

119
120

```
NOV6      GQCGYVLKPACLRQPDSTFDP----EYPGPPRTTLSIQVLTAQQLPKLNAEKPHSIVDPL 634
CAC88658  GQCGYVLKPACLRQPDSTFDP----EYPGPPRTTLSIQVLTAQQLPKLNAEKPHSIVDPL 634
Q96FL6    GQCGYVLKPACLRQPDSTFDP----EYPGPPRTTLSIQVLTAQQLPKLNAEKPHSIVDPL 511
Q60450    GACGYVLKPAFLRDPDTAFNPRALTQGPWWAQKRLRVRVTSGQQLPKVNKSK-NSIVDPK 644
Q9Z1B4    GGCGYVLKPAFLRDPDTTFNSRALTQGPWWAPKKLRVWITSGQQLPKVNKNK-NSIVDPK 655
P51178    GACGYVLKPAFLRDPNGTFNPRALAQGPWWARKRLNIRVTSGQQLPKVNKNK-NSIVDPK 655

670       680       690       700       710       720
NOV6      VRIEIHGVPADCARQETDYVLNNGFNPRWGQTLQFQLRAPELALVRFVVEDYDATSPNDF 694
CAC88658  VRIEIHGVPADCARQETDYVLNNGFNPRWGQTLQFQLRAPELALVRFVVEDYDATSPNDF 694
Q96FL6    VRIEIHGVPADCARQETDYVLNNGFNPRWGQTLQFQLRAPELALVRFVVEDYDATSPNDF 571
Q60450    VIVEVHGVGQDVASRQTAVITNNGFNPWWDTEFEFEVAVPDLALVRFVVEDYDASSKNDF 704
Q9Z1B4    VIVEIHGVGQDVASRQTAVITNNGFNPRWDTEFEFVVAVPDLALVRFMVEDYDSSSKNDF 715
P51178    VTVEIHGVSRDVASRQTAVITNNGFNPWWDTEFAFEVVVPDLALIRFIVEDYDASSKNDF 715

730       740       750       760
NOV6      VGQFTLPLSSLKQGYRHIHLLSKDGASLSPATLFIQIRIQRS 736
CAC88658  VGQFTLPLSSLKQGYRHIHLLSKDGASLSPATLFIQIRIQRS 736
Q96FL6    VGQFTLPLSSLKQGYRHIHLLSKDGASLSPATLFIQIRIQRS 613
Q60450    IGQSTIPWNSLKQGYRHVHLLSKNGDQHPSATLFVKISLQD- 745
Q9Z1B4    IGQSTIPWNSLKQGYRHVHLLSKNGDLHPSATLFVKISIQD- 756
P51178    IGQSTIPLNSLKQGYRHVHLMSKNGDQHPSATLFVKISLQD- 756
```

Additional BLASTP results are shown in Table 6E.

TABLE 6E

Patp BLASTP Analysis for NOV6

| Sequences producing High-scoring Segment Pairs | Protein/Organism | Length (aa) | Identity (%) | Positive (%) | E Value |
| --- | --- | --- | --- | --- | --- |
| patp:AAG63220 | Amino acid sequence of a human lipid metabolism enzyme | 789 | 707/736 (96%) | 713/736 (96%) | 0.0 |
| patp:AAB47516 | Human phospholipase C, 16835 | 736 | 707/736 (96%) | 713/736 (96%) | 0.0 |
| patp:AAY81394 | Rat phospholipase C-delta-1 | 756 | 382/744 (51%) | 509/744 (68%) | 2.2e-199 |
| patp:AAW01596 | Inositol-1,4,5-triphosphate binding protein | 1096 | 260/733 (35%) | 380/733 (51%) | 1.1e-105 |
| patp:AAR90583 | Phospholipase C-gamma-1 | 1290 | 149/392 (38%) | 220/392 (56%) | 3.3e-105 |

Domain results for NOV6 were collected from the Pfam database, and then identified by the Interpro domain accession number. The results are listed in Table 6F with the statistics and domain description. These results indicate that the NOV6 polypeptide has properties similar to those of other proteins known to contain these domains.

TABLE 6F. DOMAIN ANALYSIS OF NOV6

| PSSMs Producing Significant Alignments | Score (bits) | E Value |
|---|---|---|
| Phosphatidylinositol-specific phospholipase (PI-PLC)-X: domain 1 of 1, from 288 to 433 | 264.3 | 1.6e-75 |

```
(SEQ ID NO:119)           dmsiPLsHYfisSshntYLtgkQlwGkssvesYrqqLdaGcRcvELD
                                ||++||+||+++|++++||+
 +|++|++++++| +   +|+|++|||
NOV6            (SEQ ID NO:351)
DMNQPLAHYFISSSHNTYLTDSQIGGPSSTEAYVRAFAQGCRCVELD cwdGkpddepiIyHGhtltleiklkdVleaIkdfafkPtSpyPvIlSlen
              || | + +||+|+|||||+++++ +|++|++++|++ +|++|+||||||
              CWEG-PGGEPVIYHGHTLTSKILFRDVVQAVRDHAFT-VSPYPVILSLEN HcnsddqQrkmakyfkeiFgdmLltkPtlds.lttepglpLPslkdlrgK
              || + ||+ ||+++ +|+||||+|    |||+ ++|    |||+++|+|+
              HCGLE-QQAAMARHLCTILGDMLVTQA-LDSpNPEE----LPSPEQLKGR ILLknkk
              +|+|+||
              VLVKGKK
```

| PI-PLC-Y: domain 2 of 2, from 512 to 591 | 162.0 | 1e-44 |
|---|---|---|

```
(SEQ ID NO:120)           kllkespvefVkyNkrqLsRvYPkGtRvDSSNfmPqvfWnaGCQmVA
                                +|||+ +++||++| ||| |||| |+|+ |
|++||++||  |||+||
NOV6             (SEQ ID NO:352)
RLLKAWGNSFVRHNARQLTRVYPLGLRMNSANYSPQEMWNSGCQLVA LNfQTsDlpmqiNdGmFeyNggqPdGsfksGYlLKPeflR
              |||||++ +|++|  |+|+ ||+      +||+|||++||
              LNFQTPGYEMDLNAGRFLVNGQ-------CGYVLKPACLR
```

| C2: domain 1 of 1, from 609 to 699 | 89.5 | 6.7e-23 |
|---|---|---|

```
(SEQ ID NO:121)           LtVtvieArnLpkmDk..vngrlsDPYVkvsllgdkkdlkkfkTkvv
                          |++ |+ |++|||++ +++ + ++|| |+++++|++ | +++|  |
NOV6            (SEQ ID NO:353)   LSIQVLTAQQLPKLNAekPHS-
IVDPLVRIEIHGVPADCARQETDYV kktNGLNPvWneEtFvFekvplpelasktLrfaVyDedrfsrdDfiGqvt
              ++ |+||+|+  |++|+ + +||||   +||+| |+| +| +|+||+|
              LNN-GFNPRWG-QTLQFQ-LRAPELAL--VRFVVEDYDATSPNDFVGQFT
```

The NOV6 nucleic acid and protein disclosed in this invention are expressed in at least the following tissues: brain and colon. This information was derived by determining the tissue sources of the sequences that were included in the invention including but not limited to SeqCalling sources, Public EST sources, Literature sources, and/or RACE sources. The protein similarity information, expression pattern, and map location for the NOV6 protein and nucleic acid disclosed herein suggest that this protein may have important structural and/or physiological functions characteristic of the phospholipase family. Therefore, the NOV6 nucleic acids and proteins of the invention are useful in potential diagnostic and therapeutic applications and as a research tool. For example, the compositions of the present invention will have efficacy for treatment of patients suffering from: Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, hemophilia, hypercoagulation, idiopathic thrombocytopenic purpura, immunodeficiencies, graft versus host disease, lymphedema, allergies and other diseases, disorders and conditions of the like.

The novel NOV6 nucleic acids and polypeptides of the invention, or fragments thereof, are useful in diagnostic applications, wherein the presence or amount of the nucleic acid or the protein are to be assessed. These materials are further useful in the generation of antibodies that bind immunospecifically to the novel substances of the invention for use in therapeutic or diagnostic methods. These antibodies may be generated according to methods known to one ordinarily skilled in the art, using prediction from hydrophobicity charts, as described in the "Anti-NOVX Antibodies" section below.

The disclosed NOV6 protein of the invention has multiple hydrophilic regions, each of which can be used as an immunogen. The NOV6 protein also has value in the development of a powerful assay system for functional analysis of various human disorders, which will help in understanding of pathology of the disease and development of new drug targets for various disorders.

Phosphoinositide-specific phospholipase C (PLC) subtypes comprise a related group of multidomain phosphodiesterases that cleave the polar head groups from inositol lipids. Activated by all classes of cell surface receptors, these enzymes generate the ubiquitous second messengers inositol 1,4,5-trisphosphate and diacylglycerol. The former provokes a transient increase in intracellular free Ca(2+), while the latter serves as a direct activator of protein kinase C. Increase in intracellular Ca(2+) level and activated protein kinase C will further activate distinct signal transduction pathways, which induce various biological responses, e.g., cell proliferation and the immune response. Therefore, phospholipases are important membrane bound enzymes that may potentially serve as therapeutic drug targets.

NOV7

The NOV7 nucleic acid (SEQ ID NO:13) (alternatively referred to as CG55802-01) of 1059 nucleotides encodes a novel 3 alpha-hydroxy steroid dehydrogenase-like protein and is shown in Table 7A. An open reading frame for the mature protein was identified beginning with a ATG initiation codon at nucleotides 31–33 and ending with a TAA codon at nucleotides 1000–1002. Putative untranslated regions upstream from the start codon and downstream from the termination codon are underlined in Table 7A. The start and stop codons are in bold letters.

TABLE 7A

NOV7 Nucleotide Sequence (SEQ ID NO:13)
AAACATTTGCTAACCAGGCCAGTGACAGAAATGGATTCGAAATACCAGTGTGTGAAGCTGAATGATGGTCACTTCA

TGCCTGTCCTGGGATTTGGCACCTATGCGCCTGCAGAGGTACCTAAAAGTAAAGCTCTAGAGGCCGTCAAATTGGC

AATAGAAGCCGGGTTCCACCATATTGATTCTGCACATGTTTACAATAATGAGGAGCAGGTTGGACTGGCCATCCGA

AGCAAGATTGCAGATGGCAGTGTGAAGAGAAGACATATTCTACACTTCAAAGCTTTGGAGCAATTCCCATCGAC

CAGAGTTGGTCCGACCAGCCTTGGAAAGGTCACTGAAAAATCTTCAATTGGACTATGTTGACCTCTATCTTATTCA

TTTTCCAGTGTCTGTAAAGCCAGGTGAGGAAGTGATCCCAAAAGATGAAAATGGAAAAATACTATTTGACACAGTG

GATCTCTGTGCCACATGGAAGGCCCTGGAGAAATGCAGAGATGCAGGTTTAACCAGGTCCATCAGGGTGTCCAGTT

TCAATCACAAGCTGCTGGAACTCATCCTCAACAAGCCAGGGCTCAGGTACAAGCCCACCTGCAACCAGGTGGAATG

TCACCCTTACCTCAACCAGAGCAAACTCCTGGAGTTCTGCAAGTCCAAGGACATTGTTCTAGTTGCCTACAGTGCC

CTGGGATCCCAAAGAGACCCACAGTGGGTGGATCCCGACTGCCCACATCTCTTGGAGGAGCCGATCTTGAAATCCA

TTGCCAAGAAACACAGTCGAAGCCCAGGCCAGGTCGCCCTGCGCTACCAGCTGCAGCGGGAGTGGTGGTGCTGGC

CAAGAGCTTCTCTCAGGAGAGAATCAAAGAGAACTTCCAGGTATTTGACTTTGAGTTGACTCCAGAGGACATGAAA

GCCATTGATGGCCTCAACAGAAATCTCCGATATCTTTCTTTCTTCAGTCTTGCTGGACACCCTGATTATCCATTTT

CAGACAAATATTTAACATGGAGGACTTTGCGTGAGTTCTACCAGAGGCCCTGTGTGTAGATGGTGACACAGA

The NOV7 of the invention maps to chromosomes 10.

In a search of sequence databases, it was found, for example, that the NOV7 nucleic acid sequence of this invention has 940 of 1053 bases (89%) identical to a gb:GENBANK-ID:HSU05598|acc:U05598.1 mRNA from *Homo sapiens* (Human dihydrodiol dehydrogenase mRNA, complete cds).

The NOV7 polypeptide (SEQ ID NO:14) encoded by SEQ ID NO:13 is 323 amino acid residues in length and is presented using the one-letter amino acid code in Table 7B. The SignalP, Psort and/or Hydropathy results predict that NOV7 has no known signal peptide and is likely to be localized in the cytoplasm with a certainty of 0.4500. In alternative embodiments, a NOV7 polypeptide is located to the microbody (peroxisome) with a certainty of 0.3000, the mitochondrial matrix space with a certainty of 0.1000, or the lysosome (lumen) with a certainty of 0.1000.

The full amino acid sequence of the NOV7 protein of the invention has 272 of 323 amino acid residues (84%) identical to, and 302 of 323 amino acid residues (93%) similar to, the 323 amino acid residue ptnr:TREMBLNEW-ACC: BAA36169 protein from *Homo sapiens* (Human) (DD2/ BILE ACID-BINDING PROTEIN/AKR1C2/3ALPHA-HYDROXYSTEROID DEHYDROGENASE TYPE 3).

TABLE 7B

Encoded NOV7 Protein Sequence (SEQ ID NO:14)
MDSKYQCVKLNDGHFMPVLGFGTYAPAEVPKSKALEAVKLAIEAGFHHIDSAHVYNNEEQVGLAIRSKIADGSVK

REDIFYTSKLWSNSHRPELVRPALERSLKNLQLDYVDLYLIHFPVSVKPGEEVIPKDENGKILFDTVDLCATWKA

LEKCRDAGLTRSIRVSSFNHKLLELILNKPGLRYKPTCNQVECHPYLNQSKLLEFCKSKDIVLVAYSALGSQRDP

QWVDPDCPHLLEEPILKSIAKKHSRSPGQVALRYQLQRGVVVLAKSFSQERIKENFQVFDFELTPEDMKAIDGLN

RNLRYLSFFSLAGHPDYPFSDKY

The amino acid sequence of NOV7 has high homology to other proteins as shown in Table 7C.

TABLE 7C

NOV7 BLASTP Results

| Gene Index/ Identifier | Protein/Organism | Length of aa | Identity (%) | Positives (%) | Expect Value |
|---|---|---|---|---|---|
| A96A71 | ALDO-KETO REDUCTASE FAMILY 1, MEMBER C2 (DIHYDRODIOL DEHYDROGENASE 2, BILE ACID BINDING PROTEIN, 3-ALPHA HYDROXYSTEROID DEHYDROGENASE, TYPE III) (DD2/BILE ACID-BINDING PROTEIN/AKR1C2/3ALPHA-HYDROXYSTEROID DEHYDROGENASE TYPE 3) - *Homo sapiens* (Human) | 1467 | 272/323 (84%) | 302/323 (93%) | 5.4e-150 |
| P52895 | Probable trans-1,2-dihydrobenzene-1,2-diol dehydrogenase (EC 1.3.1.20) (Chlordecone reductase homolog HAKRD) (Dihydrodiol dehydrogenase/bile acid-binding protein) (DD/BABP) - *Homo sapiens* (Human) | 1453 | 269/323 (83%) | 301/323 (93%) | 1.7e-148 |
| Q04828 | Trans-1,2-dihydrobenzene-1,2-diol dehydrogenase (EC 1.3.1.20) (High-affinity hepatic bile acid-binding protein) (HBAB) (Chlordecone reductase homolog HAKRC) (Dihydrodiol dehydrogenase 2) (DD2) (20 alpha-hydroxysteroid dehydrogenase) - *Homo sapiens* (Human) | 1432 | 266/323 (82%) | 297/323 (91%) | 2.8e-146 |
| I53872 | dihydrodiol dehydrogenase (EC 1.1.1.-) - human | 1403 | 259/307 (84%) | 290/307 (94%) | 3.3e-143 |
| Q95JH6 | 3(20)ALPHA-HYDROXYSTEROID/DIHYDRODIOL/INDANOL DEHYDROGENASE (EC 1.1.1.112) - *Macaca fuscata* (Japanese macaque) | 1398 | 257/323 (79%) | 295/323 (91%) | 1.1e-142 |

A multiple sequence alignment is given in Table 7D in a ClustalW analysis comparing NOV7 with related protein sequences disclosed in Table 7C.

TABLE 7D. CLUSTALW ANALYSIS OF NOV7

1. SEQ ID NO.: 14   NOV7
2. SEQ ID NO.: 122  Q96A71
3. SEQ ID NO.: 123  P52895
4. SEQ ID NO.: 124  Q04828
5. SEQ ID NO.: 125  I53872
6. SEQ ID NO.: 126  Q95JH6

```
                 10        20        30        40        50        60
           ....|....|....|....|....|....|....|....|....|....|....|....|
NOV7       MDSKYQCVKLNDGHFMPVLGFGTYAPAEVPKSKALEAVKLAIEAGFHHIDSAHVYNNEEQ  60
Q96A71     MDSKYQCVKLNDGHFMPVLGFGTYAPAEVPKSKALEAVKLAIEAGFHHIDSAHVYNNEEQ  60
P52895     MDSKYQCVKLNDGHFMPVLGFGTYAPAEVPKSKALEAVKLAIEAGFHHIDSAHVYNNEEQ  60
Q04828     MDSKYQCVKLNDGHFMPVLGFGTYAPAEVPKSKALEATKLAIEAGFRHIDSAHLYNNEEQ  60
I53872     MDSKYQCVKLNDGHFMPVLGFGTYAPAEVPKSKALEAVKLAIEAGVHHIDSAHVYNNEEQ  60
Q95JH6     MDSKHQCVKLNDGHFMPVLGFGTYAPAEVPKNKATEATKLAIEAGFRHIDSAHLYNNEEY  60

70        80        90       100       110       120
           ....|....|....|....|....|....|....|....|....|....|....|....|
NOV7       VGLAIRSKIADGSVKREDIFYTSKLWSNSHRPELVRPALERSLKNLQLDYVDLYLIHFPV 120
Q96A71     VGLAIRSKIADGSVKREDIFYTSKLWSNSHRPELVRPALERSLKNLQLDYVDLYLIHFPV 120
P52895     VGLAIRSKIADGSVKREDIFYTSKLWSNSHRPELVRPALERSLKNLQLDYVDLYLIHFPV 120
Q04828     VGLAIRSKIADGSVKREDIFYTSKLWCNSHRPELVRPALERSLKNLQLDYVDLYLIHFPV 120
I53872     VGLAIRSKIADGSVKREDIFYTSKLWSNSHRPELVRPALERSLKNLQLDYADLYLIHFPV 120
Q95JH6     VGLAIRSKIADGSVKREDIFYTSKLWCNSHRPEFVRPALERSLKNLQLDYVDLYLIHFPV 120

130       140       150       160       170       180
           ....|....|....|....|....|....|....|....|....|....|....|....|
NOV7       SVKPGEEVIPKDENGKILFDTVDLCATWKALEKCRDAGITRSIRVSSFNHKLLELILNKP 180
Q96A71     SVKPGEEVIPKDENGKILFDTVDLCATWEAMEKCKDAGLAKSIGVSNFNHRLLEMILNKP 180
P52895     SVKPGEEVIPKDENGKILFDTVDLCATWEAMEKCKDAGLAKSIGVSNFNHRLLEMILNEP 180
Q04828     SVKPGEEVIPKDENGKILFDTVDLCATWEAVEKCKDAGLAKSIGVSNFNRRQLEMILNKP 180
I53872     SVKPGEEVIPKDENGKILFDTVDLCATWEAMEKCKDAGLAKSIGVSNFNHRLLEMILNEP 180
Q95JH6     SLKPGEELIPKDENGKLLFDTVDLCATWEAMEKCKDAGLAKSIGVSNFNRRQLEMILNKP 180

190       200       210       220       230       240
           ....|....|....|....|....|....|....|....|....|....|....|....|
NOV7       GLRYKPTCNQVECHPYLNQSKLLEFCKSKDIVLVAYSALGSQRDPQWVDPDCPHLLEEPI 240
Q96A71     GLKYKPVCNQVECHPYFNQRKLLDFCKSKDIVLVAYSALGSHREEPWVDPNSPVLLEDPV 240
P52895     GLKYEPVCNQVECHPYFNQRKLLDFCKSKDIVLVAYSALGSHREEPWVDPNSPVLLEDPV 240
Q04828     GLKYKPVCNQVECHPYFNQRKLLDFCKSKDIVLVAYSALGSHREEPWVDPNSPVLLEDPV 240
```

133 134

```
I53872    GLKYEPVCNQVECHPYFNQRKLLDFCKSKDIVLVAYSALGSHREEPWVDPNSPVLLEDPV  240
Q95JH6    GLKYKPVCNQVECHPYLNQRKLLDFCKSKDIVLVAYSALGSHREKPWVDQNSPVLLEDPV  240

250       260       270       280       290       300
              ....|....|....|....|....|....|....|....|....|....|....|....|
NOV7      LKSIAKKHSRSPGQVALRYQLQRGVVVLAKSFSQERIKENFQVFDFELTPEDMKAIDGLN  300
Q96A71    LCALAKKHKRTPALIALRYQLQRGVVVLAKSYNEQRIRQNVQVFEFQLTSEEMKAIDGLN  300
P52895    LCALAKKHKRTPALIALRYQLQRGVVVLAKSYNEQRIRQNVQVFEFQLTSEEMKAIDGLN  300
Q04828    LCALAKKHKRTPALIALRYQLQRGVVVLAKSYNEQRIRQNVQVFEFQLTSEEMKAIDGLN  300
I53872    LCALAKKHKRTPALIALRYQLQRGVVVLAKSYNEQRIRQNVQVFEFQLTSEEMKAIDGLN  300
Q95JH6    LCALAKKHKRTPALIALRYQLQRGVVVLAKSYNEQRIRENMKVFEFQLTSEDMKAIDGLD  300

310       320
              ....|....|....|....|....
NOV7      RNLRYLSFFSLAGHPDYP----FSDKY--  323
Q96A71    RNVRYLTLDIFAGPPNYP----FSDEY--  323
P52895    RNVRYLTLDIFAGPPNY--P---ISDEY--  323
Q04828    RNVRYLTLDIFAGPPNYP----FSDEY--  323
I53872    RNVRYLTLDILLAPLIIRFLMNINMEGIA  329
Q95JH6    RNIRYLTLDIFAGPPNYP----FSDEY--  323
```

Additional BLASTP results are shown in Table 7E.

TABLE 7E

Patp BLASTP Analysis for NOV7

| Sequences producing High-scoring Segment Pairs | Protein/Organism | Length (aa) | Identity (%) | Positive (%) | E Value |
|---|---|---|---|---|---|
| patp:AAB43444 | Human cancer associated protein sequence | 336 | 266/323 (82%) | 296/323 (91%) | 5.7e-146 |
| patp:AAW14799 | Type 5 17-beta-hydroxysteroid dehydrogenase-*Homo sapiens* | 323 | 249/323 (77%) | 287/323 (88%) | 1.5e-138 |
| patp:AAM78471 | Human protein No. 1133 | 323 | 249/323 (77%) | 287/323 (88%) | 1.5e-138 |
| patp:AAM79455 | Human protein No. 3101 | 325 | 249/323 (77%) | 287/323 (88%) | 1.5e-138 |
| patp:AAY41041 | Human lung tumor antigen L773P | 364 | 244/295 (82%) | 274/295 (92%) | 1.4e-133 |

Domain results for NOV7 were collected from the Pfam database, and then identified by the Interpro domain accession number. The results are listed in Table 7F with the statistics and domain description. These results indicate that the NOV7 polypeptide has properties similar to those of other proteins known to contain these domains.

that were included in the invention including but not limited to SeqCalling sources, Public EST sources, Literature sources, and/or RACE sources.

The protein similarity information, expression pattern, and map location for the NOV7 protein and nucleic acid disclosed herein suggest that this protein may have important structural and/or physiological functions characteristic

TABLE 7F

DOMAIN ANALYSIS OF NOV7

| PSSMs Producing Significant Alignments | Score (bits) | E Value |
|---|---|---|
| aldo_ket_red: domain 1 of 1, from 10 to 303 | 502.7 | 5.7e-149 |

```
 (SEQ ID NO:127)    LnnGlklmPllGlGtwqtpgeedylwgrvdkeeakeavkaAldaGY
                                 ||+|+  +||+||+||+ + +           |+|
 |  ||||  |++||+
   NOV7          (SEQ ID NO:354) LNDGH--FMPVLGFGTYAPAE--------
VPKSKALEAVKLAIEAGF RhiDtAaiYgNGqkPgqSEeevGeaikealeegsvvvitkykRediFits
            |||  |++|+|       ||+||+||++++++|||      ||||||+||
            HHIDSAHVYNN-------EEQVGLAIRSKIADGSV------KREDOFYTS dKlwntfgpDlseyghspkhvrealekSLKrLgLdYvDLyLiHwPdpfkp
            |||  ++        |+|++||+|||   |||+|+|||||||||+|++ ||
            -KLWSNS--------HRPELVRPALERSLKNLQLDYVDLYLIHFPVSVKP giedkyplgfptdddgkliyedvpieetWkAleklvdeGkvrsIGVSNfs
            |  |+    +|+|++||+++++|++++|||||||++|+|++|||  ||+|+
            G-EEV----IPKDENGKILFDTVDLCATWKALEKCRDAGLTRSIRVSSFN aeqleellsyagklklipPvvnQvElHPylrqdelrkvPLLpfCkshGIa
            ++  ||  +|+++|  |+ ++|++||||+||||+|  +|++        |||  ||++|+
            HKLLELILNKPG--LR-YKPTCNQVECHPYLNQSKLLE-----FCKSKDIV vtAySPLgaGlLtGkykteedipgdrrsllgadkgwselgspelledpvl
            ++|||  |||++                         |  +|++++ ]  |||+|+|
            LVAYSALGSQR-------------------DPQWVDPDCPHLLEEPIL kaiAekygykdktpAQvaLrWalqrGgGagvvvvIPKSsnpeRikeNlka
            |  ||+|+    ++|  ||||||++||||       |||++||++ ||||||+++
            KSIAKKHS---RSPGQVALRYQLQRG-----VVVLAKSFSQERIKENFQV fddfeLteedmkaideldrgk
            |  ||||||+|||||||+|+|+
            F-DFELTPEDMKAIDGLNRNL
```

The NOV7 nucleic acids and polypeptides disclosed in this invention are expressed in at least the following tissues: liver/spleen (pool), and gall bladder. This information was derived by determining the tissue sources of the sequences of the aldo-keto reductase family. Therefore, the NOV7 nucleic acids and proteins of the invention are useful in potential diagnostic and therapeutic applications and as a research tool. For example, the compositions of the present invention will have efficacy for treatment of patients suffering from: cancer, trauma, regeneration (in vitro and in vivo), viral/bacterial/parasitic infections, Von Hippel-Lindau (VHL) syndrome, cirrhosis, transplantation and other diseases, disorders and conditions of the like.

The novel NOV7 nucleic acids and polypeptides of the invention, or fragments thereof, are useful in diagnostic applications, wherein the presence or amount of the nucleic acid or the protein are to be assessed. These materials are further useful in the generation of antibodies that bind immunospecifically to the novel substances of the invention for use in therapeutic or diagnostic methods. These antibodies may be generated according to methods known to one ordinarily skilled in the art, using prediction from hydrophobicity charts, as described in the "Anti-NOVX Antibodies" section below.

The disclosed NOV7 protein of the invention has multiple hydrophilic regions, each of which can be used as an immunogen. The NOV7 protein also has value in the development of a powerful assay system for functional analysis of various human disorders, which will help in understanding of pathology of the disease and development of new drug targets for various disorders.

The aldo-keto reductase family includes a number of related monomeric NADPH-dependent oxidoreductases, such as aldose reductase, prostaglandin F synthase, xylose reductase, aldehyde reductases, hydroxysteroid dehydrogenases, dihydrodiol dehydrogenases and many others. All possess a similar structure, with a beta-alpha-beta fold characteristic of nucleotide binding proteins. The fold comprises a parallel beta-8/alpha-8-barrel, which contains a novel NADP-binding motif. The (alpha/beta) 8-barrel fold provides a common scaffold for an NAD(P)(H)-dependent catalytic activity, with substrate specificity determined by variation of loops on the C-terminal side of the barrel. All the aldo-keto reductases are dependent on nicotinamide cofactors for catalysis and retain a similar cofactor binding site, even among proteins with less than 30% amino acid sequence identity. Members of members of the aldo-keto reductase (AKR), short-chain dehydrogenases/reductases (SDR) and quinone reductase (QR) superfamilies are involved in reductive pathways involved in synthesis and disposition of carbonyl and hydroxyl group containing compounds.

NOV8

A disclosed NOV8 nucleic acid (SEQ ID NO:15) of 879 nucleotides (also referred to as CG55904-01) encoding a novel Squalene Desaturase-like protein is shown in Table 8A. An open reading frame was identified beginning with an ATG initiation codon at nucleotides 24–26 and ending with a TGA codon at nucleotides 861–863. Putative untranslated regions are found upstream from the initiation codon and downstream from the termination codon, and are underlined. The start and stop codons are shown in bold letters in Table 8A.

TABLE 8A

NOV8 nucleotide sequence.

(SEQ ID NO:15)
<u>ATTATAACTATTGTCACAATATA</u>ATGAAAGAACATTCAAAAACGTTCTCATATGCCTTTGATTTT

TTGGATTTAAAAAGGAAAAAAGCAATTTGGGCTATTTATGCAGTTTGCAGAATTATAGATGACAG

TATTGATAAATACAAAGACCTTGAGCAATTAAACGGCATAGCTAGAGATTTAGATGTGATTTATA

GCGATTGTGATTATATTCAAGCCTATCAAAGTGATGCAGCTATTATGAATGCTTTAAGTAATACA

TTGAATACATATTCAATACCTAAAAAACCTTTTGAATCTTTAATTCAATATGTGAAGGAAGATTT

AGTTTTAAAAGAAATGAAAACTGATTCAGATTTATATGAGTATTGCTATGGTGTGGTAGGTACTG

TCGGTGAATTGTTAACTCCTATATTAACTTCATCAAATGAAAATAATTTCGAGCAAGCTGAAGAA

GCTGCGATTGCTTTAGGCAAGGCAATGCAAATAACTAATATTTTAAGAGATGTCGGCGAAGATTT

TCAAAATGGAAGAATTTATCTAAGTGTTGAAAAATTAGCTCAATATCGAGTTAATCTACATTCTA

TATATTATGAAGGAGTTTCGCCAAATTATATAGAACTGTGGGAAAGTTACGCTACAGAGACAGTT

AGGTTATATGATATTGCATTAAACGGTATTAATTATTTTGACGAAGAGGTACGTTACATTATCGA

ATTAGCTGCGATAGCTTATCATGAAATACTTGTGGAAGTAAGGAAGGCAAACTATACGTTGCATA

AGAAAGTATATGTAAGCAAATTGAAAAAAATGAAAATTTATCGTGAACTTAGTGCGAAATATAAT

AGGAGTGAAACATTATGA<u>AGATTGCAGTTATAGG</u>

NOV8 CG55904-01 genomic clones map to chromosome 5.

In a search of sequence databases, it was found, for example, that the nucleic acid sequence of this invention has 532 of 879 bases (60%) identical to a gb:GenBank-ID: SAP1P2|acc:X73889.1 mRNA from genes crtM and crtN from S. aureus.

A disclosed NOV8 polypeptide (SEQ ID NO:16) encoded by SEQ ID NO:15 has 279 amino acid residues and is presented in Table 8B using the one-letter amino acid code. SignalP, Psort and/or Hydropathy results predict that NOV8 does not possess a signal peptide and is likely to be localized to the cytoplasm with a certainty of 0.3000. NOV8 has a molecular weight of 32387.5 Daltons.

TABLE 8B

Encoded NOV8 protein sequence.

(SEQ ID NO:16)
MKEHSKTFSYAFDFLDLKRKKAIWAIYAVCRIIDDSIDKYKDLEQLNGIA

RDLDVIYSDCDYIQAYQSDAAIMNALSNTLNTYSIPKKPFESLIQYVKED

LVLKEMKTDSDLYEYCYGVVGTVGELLTPILTSSNENNFEQAEEAAIALG

KAMQITNILRDVGEDFQNGRIYLSVEKLAQYRVNLHSIYYEGVSPNYIEL

WESYATETVRLYDIALNGINYFDEEVRYIIELAAIAYHEILVEVRKANYT

LHKKVYVSKLKKMKIYRELSAKYNRSETL

The full amino acid sequence of the protein of the invention was found to have 133 of 275 amino acid residues (48%) identical to, and 183 of 275 amino acid residues (66%) similar to, the 287 amino acid residue ptnr:SptrEmbl-ACC:Q99R75 Squalene Desaturase protein from *S. aureus*.

In a further search of public sequence databases, NOV8 was found to have homology to the amino acid sequences shown in the BLASTP data listed in Table 8C.

TABLE 8C

BLASTP results for NOV8

| Gene Index/ Identifier | Protein/Organism | Length (aa) | Identity (%) | Positives (%) | Expect |
|---|---|---|---|---|---|
| ptnr:SPTREMBL-ACC:Q99R75 | SQUALENE DESATURASE - *Staphylococcus aureus* | 287 | 133/275 (48%) | 183/275 (66%) | 1.7e-61 |
| ptnr:SPTREMBL-ACC:O07854 | SQUALENE DESATURASE - *Staphylococcus aureus* | 255 | 113/241 (46%) | 151/241 (62%) | 2.9e-48 |
| ptnr:pir-id:A55548 | crtM protein - *Staphylococcus aureus* | 254 | 104/241 (43%) | 143/241 (59%) | 4.1e-42 |
| ptnr:SPTREMBL-ACC:Q9M608 | PHYTOENE SYNTHASE - *Citrus unshiu* | 436 | 85/261 (32%) | 138/261 (52%) | 3.0e-30 |
| ptnr:SWISSNEW-ACC:P49085 | Phytoene synthase, chloroplast precursor | 410 | 89/262 (33%) | 145/262 (55%) | 1.0e-29 |

The homology of these sequences is shown graphically in the ClustalW analysis shown in Table 8D. NOV8 polypeptide is provided in lane 1.

Table 8D. ClustalW Analysis of NOV8

1) NOV8      (SEQ ID NO:16)
2) 007854    (SEQ ID NO:128)
3) A55548    (SEQ ID NO:129)
4) Q9M608    (SEQ ID NO:130)
5) P49085    (SEQ ID NO:131)

```
NOV8      ---------------------------------------------------------------------------   1
007854    ---------------------------------------------------------------------------   1
A55548    ---------------------------------------------------------------------------   1
Q9M608    MSVTLLWVVSPNSQLSNCFGFVDSVREENRLFYSSRFLYQHQTRTAVFNSRPKQFNNSNKQRRNSYPLDTDLRHPCSSGI  80
P49085    MAIILVRAASPG--LS----AADSISHQGTLQCST----------LLKTKRP------AARRWMPCSLLGLHPWEAGR   56

NOV8      --------------------------------------------------MKEHSKT                         7
007854    ----------------------------------------MTMMDMNEKYCHKIMKKHSKS                   21
A55548    ----------------------------------------MTMMDMNEKYCHKIMKKHSKS                   21
Q9M608    DLPEIS-CMVASTAGEVAMSSEEMVYNVVLKQAALVNKQPSGVTRDLDVNP-DIALPGTLSLLSEAYDRCGEVCAEYAKT 158
P49085    PSPAVYSSLPVNPAGEAVVSSEQKVYDVVLKQAALLKRQLR--TPVLDARPQDMDMP--RNGLKEAYDRCGEICEEYAKT 132

NOV8      FSYAFDFLDLKRKKAIWAIYAVCRIIDDSIDKYKDLEQLNGIARDLVIYSDCDYIGAYQSDAAIMNALSNTLNTYSIPK   87
007854    FSYAFDLLPEDQRKAVWAIYAVCRKIDDSIDVYGDIQFLIQIKEDIQSIEKYPEHHHFQSDRRIMMALQHVAQHKNIAF  101
A55548    FSYAFDLLPEDQRKAVWAIYAVCRKIDDSIDVYGDIQFLIQIKEDIQSIEKYPEHHHFQSDRRIMMALQHVAQHKNIAF  101
Q9M608    FYLGTILMTSERRRAIWAIYVWCRRTDELVDGPNASHITPTALDRWESRLEDLRRGRPED---MLDAALSDTVTKFPVDI 235
P49085    FYLGTMLMTEERRRAIWAIYVWCRRTDELVDGPNANYITPTALDRWEKRLEDLTGRPYD---MLDAALSDTLSRFPIDI  209

NOV8      KPFESLIQYVKEDLVLKEMKTDSDLYEYCYGVVGTVGELTPILTSS--NENNFEQAEEAATALGKAMQITNILRDVGED  165
007854    CSFYNLIDTVYKDQHFLMEETDAELEGYCYGVAGTVSEVLTPILS-----DHETHCTYDVARRLGESLQLINILRDVGED  176
A55548    CSFYNLIDTVYKVNILQCLKRTLELEGYCYGVAGRRSS-LDADFS-----DHETHCTYDVARRLGESLQLINILRDVGED  175
Q9M608    QPFRDMIEGMRMDLRKSRYKNFDELYLYCYYVAGTVGLMSVPVMGIAPDSQATTESVYNAALALGIANQLTNILRDVGED 315
P49085    QPFRDMIEGMRSDLRKIRNNFDELYMYCYYVAGTVGLMSVPVMGIATESKATTESVYSAALALGIANQLTNILRDVGED  289

NOV8      FQNGRIYLSVEKLAQYRVNLHSIYYEGVSPNYIELWESYATETVRLYDIALNGINYFDEEVRYIIELAALAYHEILVEVR 245
007854    FDNERIYFSKQRLKQYEVDTAEVYQNGVNNHYIDLWEYYAAIAEKDEQDVMDQIKVFSIEASPIIELAARIYIEILGRS- 255
A55548    FDNERIYFSKQRLKQYEVDTAEVYQNGVNNHYIDLWEYYAAIAEKDEQDVMDQIKVFSIEASPIIELAARIYIEILGRS- 254
```

```
Q9M608    ARRGRVYLPQDELACAGLSDDDIBAGEVTIKWRNFMKNQIKRARMFFDMAENGVTELSEASRWPVWASLLLYRQILDELE  395
P49085    ARRGRIYLPQDELACAGLSDEDIFKGVVTNRWRNFMKRQIKRARMFBEEAERGVNELSQASRWPVWASLLLYRQILDELE  369

NOV8      KANYT-LHKKVYVSKLKKMKIYRELSAKYNRSETL------  279
007854    -----------------------------------------  255
A55548    -----------------------------------------  254
Q9M608    ANDYNNFTKRAYVSKAKKEAALPIAYAKSLLRPSRIYTSKA  436
P49085    ANDYNNFTKRAYVGKGKKLLALPVAYGKSLLLPCSLRNGQT  410
```

BLAST analysis was performed on sequences from the Patp database, which is a proprietary database that contains sequences published in patents and patent publications. Patp results include those listed in Table 8E.

TABLE 8E

Patp BLASTP Analysis for NOV8

| Sequences producing High-scoring Segment Pairs | Protein/Organism | Length (aa) | Identity (%) | Positive (%) | E Value |
| --- | --- | --- | --- | --- | --- |
| patp:AAY44217 | Soybean phytoene synthase - *Glycine max* | 400 | 85/261 (32%) | 136/261 (52%) | 3.8e-30 |
| patp:AAY84101 | Amino acid sequence of a phytoene synthase polypeptide - *Lycopersicon esculentum* | 412 | 85/261 (32%) | 137/261 (52%) | 1.3e-29 |
| patp:AAW41057 | Phytoene synthase from *N. benthamiana* - *Nicotiana benthamiana* | 410 | 83/261 (31%) | 137/261 (52%) | 9.0e-29 |
| patp:AAG10658 | *Arabidopsis thaliana* protein fragment SEQ ID NO: 9068 - *Arabidopsis thaliana* | 422 | 83/261 (31%) | 134/261 (51%) | 1.2e-28 |
| patp:AAG10659 | *Arabidopsis thaliana* protein fragment SEQ ID NO: 9069 - *Arabidopsis thaliana* | 403 | 83/261 (31%) | 134/261 (51%) | 1.2e-28 |

DOMAIN results for NOV8 as disclosed in Tables 8F, were collected from the Conserved Domain Database (CDD) with Reverse Position Specific BLAST analyses. This BLAST analysis software samples domains found in the Smart and Pfam collections.

Table 8F lists the domain description from DOMAIN analysis results against NOV8. This indicates that the NOV8 sequence has properties similar to those of other proteins known to contain these domains.

```
Q9M608    ARRGRVYLPQDELACAGLSDDDIEAGEVTIKWRNFMKNQIKRARMFDMAENGVTELSEASRWPVWASLLLYRQILDEIE 395
P49085    ARRGRIYLPQDELACAGLSDEDIFKGVVTNRWRNFMKRQIKRARMFEEAERGVNELSQASRWPVWASLLLYRQILDEIE 369

NOV8      KANYT-LHKKVYVSPLKKMKIYRELSARYNRSETL------ 279
007854    ----------------------------------------- 255
A55548    ----------------------------------------- 254
Q9M608    ANDYNNFTKRAYVSKAKKLAALPIAYAKSLLRPSRIYTSKA 436
P49085    ANDYNNFTKRAYVGKGKKLLALPVAYGKSLLLPCSLRNGQT 410
```

```
MKEHSKTFSYAFDFLDLKRKKAIWAIYAVCRIIDDSID      38

SQS_PSY: domain 2 of 2, from 69 to 262: score 109.7, E = 1.5e-29
   (SEQ ID NO:133)
     DapvdraFaPCAYqALdvleefdiprepfrdlIedITkrMGaGmamD
                                       || ++ |++       +| ++
||++||+ ||            +|
   NOV8         (SEQ ID NO:356) 69    DAAIMNALS------NTLNTYSIPKKPFESLIQ-
-------YVKED 100 lekreknlqyryatfeDllrYCyyVAGtVGlmmarlmgvrkledpAdwql
            |         +|++||++|||+|  ||||+++++++  ++ ++
        101 LVLK------EMKTDSDLYEYCYGVVGTVGELLTPILTSSNENNF----- 139 eevldlrAcdLGLAlQLTNIaRDvgEDarrGPCRvYLPtewLsqyGlsle
            | +++ +|++||  |+|  |||+||||||++ |  |+||  |  |+|| ++|
        140 EQAEE-AAIALGKAMQITNILRDVGEDFQNG--RIYLSVEKLAQYRVNLH 186 dllapentdkrirrvlrrlldnArayyedAltGlagLppqsrfpiaAApq
            + ++ +++  + ++ +  +++ ++|+ || |+  ++ |  |  |+
        187 SIYYEGVSPN-YIELWESYATETVRLYDIALNGINYFDEEVRYIIELAAI 235 vYagIgdaieangydvfrrRaktrkgek<-*
            | +|+++++++++|  ++++ ++++| +|
        236 AYHEILVEVRKANY-TLHKKVYVSKLKK      262
```

NOV8 is expressed in at least the following tissues: colon, brain, lung, lumph, and tonsil (enriched for germinal center b-cells).

Squalene synthase (farnesyl-diphosphate farnesyltransferase)(SQS) belongs to the squalene and phytoene synthases family. Phytoene synthase (PSY) catalyzes the conversion of two molecules of geranylgeranyl diphosphate (GGPP) into phytoene. The reaction carried out by PSY is catalyzed in two separate steps: the first is a head-to-head condensation of the two molecules of GGPP to form prephytoene diphosphate; this intermediate is then rearranged to form phytoene. psy is found in all organisms that synthesize carotenoids: plants and photosynthetic bacteria as well as some non-photosynthetic bacteria and fungi. In bacteria PSY is encoded by the gene CTRB. In plants PSY is localized in the chloroplast.

As it can be seen from the description above, both SQS and PSY share a number of functional similarities which are also reflected at the level of their primary structure. In particular three well conserved regions are shared by SQS and PSY; they could be involved in substrate binding and/or the catalytic mechanism. Squalene synthase (farnesyl-diphosphate farnesyltransferase)(SQS) and Phytoene synthase (PSY) share a number of functional similarities. These similarities are also reflected at the level of their primary structure. In particular, three well conserved regions are shared by SQS and PSY; they could be involved in substrate binding and/or the catalytic mechanism. Squalene synthase (farnesyl-diphosphate farnesyltransferase)(SQS) catalyzes the conversion of two molecules of farnesyl diphosphate (FPP) into squalene. It is the first committed step in the cholesterol biosynthetic pathway. The reaction carried out by SQS is catalyzed in two separate steps: the first is a head-to-head condensation of the two molecules of FPP to form presqualene diphosphate; this intermediate is then rearranged in a NADP-dependent reduction, to form squalene: 2 FPP→presqualene diphosphate+ NADP→squalene SQS is found in eukaryotes. In yeast is is encoded by the ERG9 gene, in mammals by the FDFT1 gene.

The nucleic acids and proteins of the invention are useful in potential diagnostic and therapeutic applications implicated in various diseases and disorders described below and/or other pathologies. For example, the compositions of the present invention will have efficacy for treatment of patients such as: Obesity, dietary disorders, Von Hippel-Lindau (VHL) syndrome, Alzheimer's disease, Stroke, Tuberous sclerosis, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain, Neuroprotection, Tonsilitis, Lymphedema, Allergies, Systemic lupus erythematosus, Autoimmune disease, Asthma, Emphysema, Scleroderma, allergies, ARDS and other diseases, disorders and conditions of the like.

As described earlier, NOV8 shares extensive sequence homologies with Squalene Desaturase family proteins. The structural similarities indicate that NOV8 may function as a member of Squalene Desaturase family proteins. Accordingly, the NOV8 nucleic acids and proteins identified here may be useful in potential therapeutic applications implicated in (but not limited to) various pathologies and disorders as indicated herein. For example, a cDNA encoding the Squalene Desaturase-like protein NOV8 may be useful in gene therapy, and the Squalene Desaturase-like protein NOV8 may be useful when administered to a subject in need thereof. The NOV8 nucleic acid encoding Squalene Desaturase-like protein, and the Squalene Desaturase-like protein of the invention, or fragments thereof, may further be useful in diagnostic applications, wherein the presence or amount of the nucleic acid or the protein are to be assessed. Additional disease indications and tissue expression for NOV8 and NOV8 variants, if available, are presented in the Examples.

NOV8 nucleic acids and polypeptides are further useful in the generation of antibodies that bind immuno-specifically to the novel NOV8 substances for use in therapeutic or diagnostic methods. These antibodies may be generated according to methods known in the art, using prediction from hydrophobicity charts, as described in the "Anti-NOVX Antibodies" section below. The disclosed NOV8 protein has multiple hydrophilic regions, each of which can be used as an immunogen. In one embodiment, a contemplated NOV8 epitope is from about amino acids 1 to 35. In another embodiment, a NOV8 epitope is from about amino acids 50 to 85. In additional embodiments, NOV8 epitopes are from about amino acids 95 to 125, from about amino acids 175 to 200, from about amino acids 215 to 325, and from about amino acids 335 to 711. These novel proteins can be used in assay systems for functional analysis of various human disorders, which will help in understanding of pathology of the disease and development of new drug targets for various disorders.

NOV9

A disclosed NOV9 nucleic acid (SEQ ID NO:17) of 939 nucleotides (also referred to as CG55954-01) encoding a novel Lymphocyte Antigen 64-like protein is shown in Table 9A. An open reading frame was identified beginning with an ATG initiation codon at nucleotides 140–142 and ending with a TAA codon at nucleotides 920–922. Putative untranslated regions are found upstream from the initiation codon and downstream from the termination codon, and are underlined. The start and stop codons are shown in bold letters in Table 9A.

TABLE 9A

| NOV9 nucleotide sequence |
|---|
| (SEQ ID NO:17) |
| TTAGCAAGTCGCATTATCCTCACTAAAGGGAACAAAAGCTGGAGCTCCACCGCGGTGGCGGCCGC |
| TCTAGAACTAGTGGATCCCCCGGGCTGCAGGAATTCGGCACGAGGGTAAACCCACCAAGCAATCC |

TABLE 9A-continued

NOV9 nucleotide sequence

TAGCCTGTGATGGCGTTTGACGTCAGCTGCTTCTTTTGGGTGGTGCTGTTTTCTGCCGGCTGTAA

AGTCATCACCTCCTGGGATCAGATGTGCATTGAGAAAGAAGCCAACAAAACATATAACTGTGAAA

ATTTAGGTCTCAGTGAAATCCCTGACACTCTACCAAACACAACAGAATTTTTGGAATTCAGCTTT

AATTTTTTGCCTACAATTCACAATAGAACCTTCAGCAATCAGCATCTTCTAGCAGGCCTACCAGT

TCTCCGGCATCTCAACTTAAAAGGGAATCACTTTCAAGATGGGACTATCACGAAGACCAACCTAC

TTCAGACCGTGGGCAGCTTGGAGGTTCTGATTTTGTCCTCTTGTGGTCTCCTCTCTATAGACCAG

CAAGCATTCCACAGCTTGGGAAAAATGAGCCATGTAGACTTAAGCCACAACAGCCTGACATGCGA

CAGCATTGATTCTCTTAGCCATCTTAAGGGAATCTACCTCAATCTGGCTGCCAACAGCATTAACA

TCATCTCACCCCGTCTCCTCCCTATCTTGTCCCAGCAGAGCACCATTAATTTAAGTCATAACCCC

CTGGACTGCACTTGCTCGAATATTCATTTCTTAACATGGTACAAAGAAAACCTGCACAAACTTGA

AGGCTCGGAGGAGACCACGTGTGCAAACCCGCCATCTCTAAGGGGAGTTAAGCTATCTACCTCAA

TCTGGCTGCCAACAGCATTAACATCATCTCACCCCGTCTCCTCCCTATCTTGTCCCAGCAGAGCA

CCATTAATTTAAGTCATAACCCCCTGGAA

---

NOV9 CG55954-01 genomic clones map to chromosome 5q12.

In a search of sequence databases, it was found, for example, that the nucleic acid sequence of this invention has 487 of 492 bases (98%) identical to a gb:GenBank-ID: D83597|acc:D83597.1 mRNA from *Homo sapiens* (RP105, complete cds).

A disclosed NOV9 polypeptide (SEQ ID NO:18) encoded by SEQ ID NO:17 has 260 amino acid residues and is presented in Table 9B using the one-letter amino acid code. NOV9 has an INTEGRAL Likelihood of –2.39 that it is a transmembrane protein. SignalP, Psort and/or Hydropathy results predict that NOV9 has a signal peptide and is likely to be localized to the plasma membrane with a certainty of 0.4600. The most likely cleavage site for a NOV9 peptide is between amino acids 23 and 24, i.e., at the dash between amino acids ITS-WD. NOV9 has a molecular weight of 28738.5 Daltons.

The full amino acid sequence of the protein of the invention was found to have 166 of 189 amino acid residues (87%) identical to, and 172 of 189 amino acid residues (91%) similar to, the 661 amino acid residue ptnr:SptrEmbl-ACC:Q99467 Lymphcyte Antigen 64 precursor protein from *Homo sapiens*.

In a further search of public sequence databases, NOV9 was found to have homology to the amino acid sequences shown in the BLASTP data listed in Table 9C.

TABLE 9B

Encoded NOV9 protein sequence.

SEQ ID NO:18

MAFDVSCFFWVVLFSAGCKVITSWDQMCIEKEANKTYNCENLGLSEIPDTLPNTTEFLEFSFNFLPTIHN

RTFSNQHLLAGLPVLRHLNLKGNHFQDGTITKTNLLQTVGSLEVLILSSCGLLSIDQQAFHSLGKMSHVD

LSHNSLTCDSIDSLSHLKGIYLNLAANSINIISPRLLPILSQQSTINLSHNPLDCTCSNIHFLTWYKENL

HKLEGSEETTCANPPSLRGVKLSTSIWLPTALTSSHPVSSLSCPSRAPLI

TABLE 9C

BLASTP results for NOV9

| Gene Index/ Identifier | Protein/Organism | Length (aa) | Identity (%) | Positives (%) | Expect |
| --- | --- | --- | --- | --- | --- |
| ptnr:SPTREMBL-ACC:Q99467 | LYMPHOCYTE ANTIGEN 64 PRECURSOR (RP105) - *Homo sapiens* | 661 | 166/189 (87%) | 172/189 (91%) | 8.3e-83 |
| ptnr:SPTREMBL-ACC:Q62192 | LYMPHOCYTE ANTIGEN 78 PRECURSOR (RP105) - *Mus musculus* | 661 | 111/160 (69%) | 128/160 (80%) | 1.4e-55 |

The homology of these sequences is shown graphically in the ClustalW analysis shown in Table 9D. NOV9 polypeptide is provided in lane 1.

Table 9D. ClustalW Analysis of NOV9

1) NOV9 (SEQ ID NO:18)
2) Q99467 (SEQ ID NO:134)
3) Q62192 (SEQ ID NO:135)

```
NOV9     MAFDVSCFFWVVLFSAGCKVITSWDQMCIEKEANKTYNCENLGLSEIPDTLPNTTEFLEFSFNFLPTIHNRTFS------  74
Q99467   MAFDVSCFFWVVLFSAGCKVITSWDQMCIEKEANKTYNCENLGLSEIPDTLPNTTEFLEFSFNFLPTIHNRTFSRLMNLT  80
Q62192   MAPDISCFFIVALFLASCRATTSSDCKCIEKEVNKTYNCENLGLNEIPGTLPNSTECLEFSFNVLPTIQNTTFS------  74

NOV9     --------------------------------------------------------------------------------  74
Q99467   FLDLTRCQINWIHEDTFQSHHQLSTLVLTGNPLIFMAETSLNGPKSLKHLFLIQTGISNLEFIPVHNLENLESLYLGSNH 160
Q62192   --------------------------------------------------------------------------------  74

NOV9     --------------------------------------------------------------------------------  74
Q99467   ISSIKFPKDFPARNLKVLDFQNNAIHYISREDMRSLEQAINLSLNFNGNNVKGIELGAFDSTVFQSLNFGGTPNLSVIFN 240
```

```
Q62192  ----------------------------------------------------------------------  74

NOV9    ----------------------------------------------------------------------  74
Q99467  GLQNSTTQSLWLGTFEDIDDEDISSAMLKGLCEMSVESLNLQEHRFSDISSTTFQCFTQLQELDLTATHLKGLPSGMKGL  320
Q62192  ----------------------------------------------------------------------  74

NOV9    ----------------------------------------------------------------------  74
Q99467  NLLKKLVLSVNHFDQLCQISAANFPSLTHLYIRGNVKKLHLGVGCLEKLGNLQTLDLSHNDIEASDCCSLQLKNLSHLQT  400
Q62192  ----------------------------------------------------------------------  74

NOV9    ------------------------------------------NQHLLAGLPVLRHLNLKGNH  94
Q99467  LNLSHNEPLGLQSQAFKECPQLELLDLAFTRLHINAPQSPFQNLHFLQVLNLTYCFLDTSNQHLLAGLPVLRHLNLKGNH  480
Q62192  -----------------------------------------------------RLINLT---  80

NOV9    FQDGTITKTNLLQTVGSLEVLILSSCGLLSIDQQAFHSLGKMSHVDLSHNSLTCDSIDSLSHLKGIYLNLAANSINIISF  174
Q99467  FQDGTITKTNLLQTVGSLEVLILSSCGLLSIDQQAFHSLGKMSHVDLSHNSLTCDSIDSLSHLKGIYLNLAANSINIISF  560
Q62192  FLD-----------------LTRCQTYWIHEDTFQSQHRLDTLVLTANPLIFMAETALSGPK--------------AL  127

NOV9    RLLPILSQQSTINLSHNPLDCTCSNIHFLTWYKENLHKLEGSEETTCANPPSLRGVKLS--------TSIWLPTAFTSSE  246
Q99467  RLLPILSQQSTINLSHNPLDCTCSNIHFLTWYKENLHKLEGSEETTCANPPSLRGVKLSDVKLSCGITAIGIFFLVFLL  640
Q62192  KHLFFQ--QTGI---------S---SIDFIP-----LH----------NQKILESLYLG----------------SNE  160

NOV9    PVSSLSCPSRAPLI------  260
Q99467  LLAILLFFAVKYLLRWKYQHI  661
Q62192  --------------------  160
```

BLAST analysis was performed on sequences from the Patp database, which is a proprietary database that contains sequences published in patents and patent publications. Patp results include those listed in Table 9E.

tance against irradiation-induced apoptosis and massive B-cell proliferation. RP105 has tandem repeats of a leucine-rich motif in the extracellular domain that is expected to be involved in protein—protein interactions. Role of RP105

TABLE 9E

Patp BLASTP Analysis for NOV9

| Sequences producing High-scoring Segment Pairs | Protein/Organism | Length (aa) | Identity (%) | Positive (%) | E Value |
|---|---|---|---|---|---|
| patp:AAW28510 | Product of clone J422 - Homo sapiens | 661 | 166/189 (87%) | 172/189 (91%) | 6.4e-83 |
| patp:AAW87556 | B cell surface protein sequence - Homo sapiens | 661 | 166/189 (87%), | 172/189 (91%) | 6.4e-83 |
| patp:AAY82527 | Human RP105 protein sequence | 650 | 166/189 (87%) | 172/189 (91%) | 6.4e-83 |
| patp:AAW47274 | Human B-cell activation and survival antigen-1 | 661 | 163/189 (86%) | 169/189 (89%) | 1.1e-80 |
| patp:AAY11833 | Human 5' EST secreted protein | 75 | 72/74 (97%) | 72/74 (97%) | 1.2e-35 |

DOMAIN results for NOV9 as disclosed in Tables 9F, were collected from the Conserved Domain Database (CDD) with Reverse Position Specific BLAST analyses. This BLAST analysis software samples domains found in the Smart and Pfam collections. Table 9F lists the domain description from DOMAIN analysis results against NOV9.

has been implicated not only in B cell proliferation but also in secretion of large quantities of LPS-neutralizing antibodies as an innate immune responses to bacterial cell wall lipopolysaccharide. Loss of RP105 has been implicated in increased disease activity in systemic lupus erythematosus.

TABLE 9F

Domain Analysis of NOV9

| PSSMs producing significant alignments: | | Score (bits) | E value |
|---|---|---|---|
| LRRCT (InterPro) | Leucine rich repeat C-terminal domain | 44.4 | 2.6e-09 |
| LRR (InterPro) | Leucine Rich Repeat | 28.8 | 0.00013 |

```
LRR: domain 1 of 4, from 54 to 77: score 4.2, E = 1.7e+02
   (SEQ ID NO:136)            nLeeLdLsnNnLsGslPpesfgnLp<-*
                                      |+|   |+|  |   ++++ +|+| +
   NOV9        (SEQ ID NO:357) 54    TTEFLEFSFNFLP-TIHNRTFSNQH    77

LRR: domain 2 of 4, from 84 to 107: score 4.1, E = 1.7e+02
   (SEQ ID NO:137)            nLeeLdLsnNnLs.GslPpesfgnLp<-*
                                      |++|+| +|++++|++         |+
   NOV9        (SEQ ID NO:358) 84    VLRHLNLKGNHFQdGTITK--TNLLQ    107

LRR: domain 3 of 4, from 111 to 134: score 16.6, E = 0.59
   (SEQ ID NO:138)            nLeeLdLsnNnLsGslPpesfgnLp<-*
                                      +||+| ||++ |   |+ +++| +|
   NOV9        (SEQ ID NO:359) 111    SLEVLILSSCGLL-SIDQQAFHSLG    134

LRR: domain 4 of 4, from 135 to 158: score 14.0, E = 3.7
   (SEQ ID NO:139)            nLeeLdLsnNnLsGslPpesfgnLp<-*
                                      +  + |||+|+|+   + +|+++|+
   NOV9        (SEQ ID NO:360) 135    KMSHVDLSHNSLT-CDSIDSLSHLK    158

LRRCT: domain 1 of 1, from 191 to 254: score 44.4, E = 2.6e-09
   (SEQ ID NO:140)            NPfnCDCeLrwLlrWlretnprrledqedlrCasPeslrGqpl....
                              ||++|+|+    +|+| +| |
+||++|+++||+|+|||| +|+++
   NOV9        (SEQ ID NO:361) 191    NPLDCTCSNIHFLTWYKE-
NLHKLEGSEETTCANPPSLRGVKLstsi 236

.....lellp..sdfsCp<-*
                                    ++ |+ +++ |++|||
                              237 wlptaLTSSHpvSSLSCP    254
```

Lymphocyte antigen 64 (RP105) is a B cell Toll like receptor (TLR) that transmits a growth-promoting signal and is implicated in the life/death decision of B cells. The growth-promoting signal activation by RP105 leads to resis- The nucleic acids and proteins of the invention are useful in potential diagnostic and therapeutic applications implicated in various diseases and disorders described below and/or other pathologies. For example, the compositions of the present invention will have efficacy for treatment of patients suffering from: bacterial infection, allergic disease such as asthma, B cell neoplasms, auto-immune diseases such as systemic lupus erythematosus (SLE), histocystic leukemia, hairy cell leukaemia, prolymphocytic leukaemia, myelomas and other diseases, disorders and conditions of the like.

NOV9 shares extensive sequence homologies with Lymphocyte Antigen 64 family proteins. The structural similarities indicate that NOV9 may function as a member of Lymphocyte Antigen 64 family proteins. Accordingly, the NOV9 nucleic acids and proteins identified here may be useful in potential therapeutic applications implicated in (but not limited to) various pathologies and disorders as indicated herein. For example, a cDNA encoding the Lymphocyte Antigen 64-like protein NOV9 may be useful in gene therapy, and the Lymphocyte Antigen 64-like protein NOV9 may be useful when administered to a subject in need thereof. The NOV9 nucleic acid encoding Lymphocyte Antigen 64-like protein, and the Lymphocyte Antigen 64-like protein of the invention, or fragments thereof, may further be useful in diagnostic applications, wherein the presence or amount of the nucleic acid or the protein are to be assessed.

The Lymphocyte Antigen 64 disclosed in this invention is expressed in at least the following tissues: Adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Based on the tissues in which NOV9 is most highly expressed, specific uses include developing products for the diagnosis or treatment of a variety of diseases and disorders associated therewith. Additional specific expression of NOV9 in normal and diseased tissues are shown in the Examples.

NOV9 nucleic acids and polypeptides are further useful in the generation of antibodies that bind immuno-specifically to the novel NOV9 substances for use in therapeutic or diagnostic methods. These antibodies may be generated according to methods known in the art, using prediction from hydrophobicity charts, as described in the "Anti-NOVX Antibodies" section below. The disclosed NOV9 protein has multiple hydrophilic regions, each of which can be used as an immunogen. In one embodiment, a contemplated NOV9 epitope is from about amino acids 1 to 35. In another embodiment, a NOV9 epitope is from about amino acids 50 to 85. In additional embodiments, NOV9 epitopes are from about amino acids 95 to 125, from about amino acids 175 to 200, from about amino acids 215 to 325, and from about amino acids 335 to 711. These novel proteins can be used in assay systems for functional analysis of various human disorders, which will help in understanding of pathology of the disease and development of new drug targets for various disorders.

NOV10

A disclosed NOV10 nucleic acid (SEQ ID NO:19) of 2349 nucleotides (also referred to as CG55910-01) encoding a novel ACYL-COA DESATURASE-like protein is shown in Table 10A. An open reading frame was identified beginning with an ATG initiation codon at nucleotides 260–262 and ending with a TGA codon at nucleotides 1250–1252. Putative untranslated regions are found upstream from the initiation codon and downstream from the termination codon, and are underlined. The start and stop codons are shown in bold letters in Table 10A.

TABLE 10A

NOV10 nucleotide sequence.

(SEQ ID NO:19)

TATTTTAATCCCCCCCCCCCCCGAGCCATATGGGGGATACGCCAGCAACAGACGCCGGCCGCC

AAGATCTGCATCCCTAGGCCACGCTAAGACCCTGGGGAAGAGCGCAGGAGCCCGGGAGAAGGGC

TGGAAGGAGGGGACTGGACGTGCGGAGAATTCCCCCCTAAAAGGCAGAAGCCCCGCCCCCACC

CTCGAGCTCCGCTCGGGCAGAGCGCCTGCCTGCCTGCCGCTGCTGCGGGCGCCCACCTCGCCCA

GCCATGCCAGGCCCGGCCACCGACGCGGGGAAGATCCCTTTCTGCGACGCCAAGGAAGAAATCC

GTGCCGGGCTCGAAAGCTCTGAGGGCGGCGGCGGCCCGGAGAGGCCAGGCGCGCGCGGGCAGCG

GCAGAACATCGTCTGGAGGAATGTCGTCCTGATGAGCTTGCTCCACTTGGGGGCCGTGTACTCC

CTGGTGCTCATCCCCAAAGCCAAGCCACTCACTCTGCTCTGGGCCTACTTCTGCTTCCTCCTGG

CCGCTCTGGGTGTGACAGCTGGTGCCCATCGCTTGTGGAGCCACAGGTCCTACCGGGCCAAGCT

GCCTCTGAGGATATTTCTGGCTGTCGCCAACTCCATGGCTTTCCAGAATGACATCTTCGAGTGG

TCCAGGGACCACCGAGCCCACCACAAGTACTCAGAGACGGATGCTGACCCCCACAATGCCCGCC

GGGGCTTCTTCTTCTCCCATATTGGGTGGCTGTTTGTTCGCAAGCATCGAGATGTTATTGAGAA

GGGGAGAAAGCTTGACGTCACTGACCTGCTTGCTGATCCTGTGGTCCGGATCCAGAGAAAGTAC

TATAAGATCTCCGTGGTGCTCATGTGCTTTGTGGTCCCCACGCTGGTGCCCTGGTACATCTGGG

GAGAGAGTCTGTGGAATTCCTACTTCTTGGCCTCTATTCTCCGCTATACCATCTCACTCAACAT

CAGCTGGCTGGTCAACAGCGCCGCCCACATGTATGGAAACCGGCCCTATGACAAGCACATCAGC

TABLE 10A-continued

NOV10 nucleotide sequence.

CCTCGGCAGAACCCACTCGTCGCTCTGGGTGCCATTGGTGAAGGCTTCCATAATTACCATCACA

CCTTTCCCTTTGACTACTCTGCGAGTGAATTTGGCTTAAATTTTAACCCAACCACCTGGTTCAT

TGATTTCATGTGCTGGCTGGGGCTGGCCACTGACCGCAAACGGGCAACCAAGCCGATGATCGAG

GCCCGGAAGGCCAGGACTGGAGACAGCAGTGCTTGAACTTGGAACAGCCATCCCACATGTCTGC

CGTTGCAACCTCGGTTCATGGCTTTGGTTACAATAGCTCTCTTGTACATTGGATCGTGGGAGGG

GGCAGAGGGTGGGGAAGGAACGAGTCAATGTGGTTTGGGAATGTTTTTGTTTATCTCAAAATAA

TGTTGAAATACAATTATCAATGAAAAAACTTTCGTTTTTTTTTTGGTTGGTTTTGTTTTTGAG

ACAGAGTCTCACTCTGTCACCCAGGCTGGAGTGCAGTGGCGCAGTCTCGGCTCACTGCAGCCTC

CACCTACCTGGTTCAAGCAATTCTCCTGCCTCAGCCTCCTGAGTAGCTGAGATTACAGGAGCCT

GCCACCACACCCAGCTAATTTTTTTGTATTTTTAGTAGAGACAGGGTTTCATCATGTTGGCCAG

ACTGGCCTCGAATTCCTGACCTCAGGCAATCCACCCGCCTCGGCCTCCCAAAGAGCTGGGATTA

CAGGCGTGAGCCACCGCACCCTGCCGAAAAAAACTTTTTTTTTTTGAGACGGAGGCTCGCTCTG

TCCCCCAGGTCTGGATGTGCAGTGGCGAGATTTCAGCTCACTGACAAGCTCCGCCTCCCGGGGT

TCACGCCATTCTCCTGCCTCAGCCTCCCGAGTAGCTGGGGAGCCAGCGCGCCCAGCCTAAAAAA

CTTTTCAGGTCAATATTACTACGATTTAACTTTACGAGTGTGGACCTGTGATTTAATCGGCTAT

TAGCTAAGAATAGCGTCAAATTATTCGTGTGTCATTGTGGCTTGAACATTGATGGCTAACCCTT

CCTGGAAAGGGATGAAGGCAAAGTAATATTTCTTTTAGTGGTAGTTCAGGAGACCATGTGGTCT

CCTTTGTCTACCAATTTACCCGATCATGTGTTATTAAAACACCCCTTCTGGAGGACAAAGAGGG

GTTACACACACAGGGGTCTTGTCGGGCAACACAGCAGGTCCGGTGACCATCGGGCGGCGGGGTC

TCGCGGCTCCAACTCACCCGGCACACACGACAACAGACGGGCTGATCTCGGGGTACCGGAAGCC

TCGTCGAAACAAATATCGCCGTTTTGCTCGACGCCAAACTGCTAT

The ACYL-COA DESATURASE NOV110 disclosed in this invention maps to chromosome 4.

In a search of sequence databases, it was found, for example, that the nucleic acid sequence of this invention has 805 of 808 bases (99%) identical to a gb:GENBANK-ID: AK024685|acc:AK024685.1 mRNA from *Homo sapiens* (*Homo sapiens* cDNA: FLJ21032 fis, clone CAE07365).

A disclosed NOV10 polypeptide (SEQ ID NO:20) encoded by SEQ ID NO:19 has 330 amino acid residues and is presented in Table 10B using the one-letter amino acid code. SignalP, Psort and/or Hydropathy results predict that NOV10 has a signal peptide and is likely to be localized extracellularly with a certainty of 0.6000. In an alternative embodiment, NOV10 is likely to be localized to the Golgi with a certainty of 0.4000, or to the endoplasmic reticulum (membrane) with a certainty of 0.3000, or to the microbody (peroxisome) with a certainty of 0.3000. NOV10 is likely a Type IIIa membrane protein (Ncyt Cexo) and has a likely cleavage site between pos. 16 and 17, i.e., at the dash in the amino acid sequence CDA-KE.

TABLE 10B

Encoded NOV10 protein sequence.

(SEQ ID NO:20)
MPGPATDAGKIPFCDAKEEIRAGLESSEGGGGPERPGARGQRQNIVWRNV

VLMSLLHLGAVYSLVLIPKAKPLTLLWAYFCFLLAALGVTAGAHRLWSHR

SYRAKLPLRIFLAVANSMAFQNDIFEWSRDHRAHHKYSETDADPHNARRG

FFFSHIGWLFVRKHRDVIEKGRKLDVTDLLADPVVRIQRKYYKISVVLMC

FVVPTLVPWYIWGESLWNSYFLASILRYTISLNISWLVNSAAHMYGNRPY

DKHISPRQNPLVALGAIGEGFHNYHHTFPFDYSASEFGLNFNPTTWFIDF

MCWLGLATDRKRATKPMIEARKARTGDSSA

The full amino acid sequence of the protein of the invention was found to have 203 of 284 amino acid residues (71%) identical to, and 242 of 284 amino acid residues (85%) similar to, the 357 amino acid residue ptnr:SP-TREMBL-ACC:Q9YGM2 protein from *Gallus gallus*

(Chicken) (ACYL-COA DESATURASE 1 (EC 1.14.99.5) (STEAROYL-COA DESATURASE 1) (FATTY ACID DESATURASE 1).

In a further search of public sequence databases, NOV10 was found to have homology to the amino acid sequences shown in the BLASTP data listed in Table 10C.

TABLE 10C

BLASTP results for NOV10

| Gene Index/ Identifier | Protein/Organism | Length (aa) | Identity (%) | Positives (%) | Expect |
|---|---|---|---|---|---|
| ptnr:REMTREMBL-ACC:CAC88580 | SEQUENCE 1 FROM PATENT WO0166758 - *Homo sapiens* | 330 | 330/330 (100%) | 330/330 (100%) | 1.8e-183 |
| ptnr:SPTREMBL-ACC:Q9YGM2 | ACYL-COA DESATURASE (EC 1.14.99.5) (STEAROYL-COA DESATURASE) (FATTY ACID DESATURASE) (DELTA(9) -DESATURASE) - *Gallus gallus* | 357 | 203/284 (71%) | 242/284 (85%) | 2.7e-116 |
| ptnr:SPTREMBL-ACC:Q9PW15 | ACYL-COA DESATURASE (EC 1.14.99.5) (STEAROYL-COA DESATURASE) (FATTY ACID DESATURASE) (DELTA(9) -DESATURASE) - *Ctenopharyngodon idella* | 324 | 200/285 (70%) | 236/285 (82%) | 1.7e-114 |
| ptnr:SPTREMBL-ACC:Q92038 | ACYL-COA DESATURASE (EC 1.14.99.5) (STEAROYL-COA DESATURASE) (FATTY ACID DESATURASE) (DELTA(9) -DESATURASE) - *Cyprinus carpio* | 327 | 200/286 (69%) | 234/286 (81%) | 2.0e-113 |
| ptnr:SPTREMBL-ACC:Q9PU86 | ACYL-COA DESATURASE (EC 1.14.99.5) (STEAROYL-COA DESATURASE) (FATTY ACID DESATURASE) (DELTA(9) -DESATURASE) - *Cyprinus carpio* | 324 | 201/285 (70%) | 230/285 (80%) | 6.7e-113 |

The homology of these sequences is shown graphically in the ClustalW analysis shown in Table 10D. The NOV10 polypeptide is provided in lane 1.

Table 10D. ClustalW Analysis of NOV10

1) NOV10     (SEQ ID NO:20)
2) CAC88580  (SEQ ID NO:141)
3) Q9YGM2    (SEQ ID NO:142)
4) Q9PW15    (SEQ ID NO:143)
5) Q92038    (SEQ ID NO:144)
6) Q9PU86    (SEQ ID NO:145)

```
                 10         20         30         40         50         60         70         80
            ....|....|....|....|....|....|....|....|....|....|....|....|....|....|....|....|
NOV10       MPGPATDAGKIP------------------------FCDAKEEIRAGLESSEGGGGPERPGARGQRQNIVWRNVVLMS
CAC88580    MPGPATDAGKIP------------------------FCDAKEEIRAGLESSEGGGGPERPGARGQRQNIVWRNVVLMS
Q9YGM2      MPAHLLQEEEFPSSASSTTTVTSRVTKNGNVIMEKDLLNHDDVAAER-GMVDDLFDETYREKEGPK-PPLRYVWRNIILMS
Q9PW15      MPDMDLLAQARR--------------------------AE---TVEDVFDHTYKEKEGPK-PPIVVVWRNVLMT
Q92038      MPDRELKSPIWH----------------------PEP-GTVEDVFDHTYKEKEGPK-PPTVIVWRNVLMS
Q9PU86      MPDRDIKSPIWH----------------------PE---TVEDVFDHTYKEKEGPK-PPTVIVWRNVLMA 90        100        110        120        130        140        150        160
            ....|....|....|....|....|....|....|....|....|....|....|....|....|....|....|....|
NOV10       LLHLGAVYSLVLIPKAKPLTLLWAYPCFLLAALGVTAGAHRLWSHRSYRAKLPLRIFLAVANSMAFQNDIEEWSRDHRAH
CAC88580    LLHLGAVYSLVLIPKAKPLTLLWAYPCFLLAALGVTAGAHRLWSHRSYRAKLPLRIFLAVANSMAFQNDIEEWSRDHRAH
Q9YGM2      LLHLGALIGLTLIPSAKIQTLAWAILCFVLSALGITAGSHRLWSHRSYKALLPLRIFLTIANSMAFQNDIYEWARDHRVH
Q9PW15      LLHTGALYGLLLIPSASFLTLIWTPACFVYSALGITAGAHRLWSHRSYKASLPLRIFLAFANSMAFQNDIYEWSRDHRVH
Q92038      LLHLGALYGLFLFPSARALTWIWFFGCLLFSALGLTAGAHRLWSHRSYKASLPLQIFLACGNSMAFQNDIYEWSRDHRVH
Q9PU86      FLHTGALYGLVLFPSASVLTWIWFLACFVFSALGVTAGAHRLWSRRSYKASLPLRIFLAFANSMGFQNDIYEWSRDHRVH 170        180        190        200        210        220        230        240
            ....|....|....|....|....|....|....|....|....|....|....|....|....|....|....|....|
NOV10       HKYSETDADPHNARRGFFFSHIGWLPVRKHRDVIEKGRKLDVIDLLADPVVRIQRKYYFISVVLMCFVVPTLVPWYIWGE
CAC88580    HKYSETDADPHNARRGFFFSHIGWLPVRKHRDVIEKGRKLDVIDLLADPVVRIQRKYYFISVVLMCFVVPTLVPWYIWGE
Q9YGM2      HKFSETHADPHNAMRGYFFSHMAWLLVRKHPDVIEKGQKLDLSDLKADKVVMFQRRYYKPSVVLLCFTLPTLVPWYFWDE
Q9PW15      HKYSETDADPHNAVRGFFFHIGWLLVRKHPDVIEKGRKLEISDLKADKVVMFQRRHYKPSVLLMCFFVPMFVPWEFWGE
Q92038      HKYSETDADPHNAVRGFFFSHVGWLLVRKHPDVIEKGRKLELSDLKADKVVMFQRREYKPSVLLMCFFVPTEVPWYVWGE
Q9PU86      HKYSETDADPHNAVRGFFFSHIGWLLVRKHPDVIEKGRKLRLSDLKADKVVMFQRREYKSSVLLMCFFVPTEVPWYVWGE 250        260        270        280        290        300        310        320
            ....|....|....|....|....|....|....|....|....|....|....|....|....|....|....|....|
NOV10       SLWNSYFLASILRYTISLNISWLVNSAAHMYGNRPYDKHISPRQNPLVALGAIGEGFHNYHHTFPFDYSASEFGLNFNPT
CAC88580    SLWNSYFLASILRYTISLNISWLVNSAAHMYGNRPYDKHISPRQNPLVALGAIGEGFHNYHHTFPFDYSASEFGLNFNPT
```

```
Q9YGM2    SIILSEFIPAILRYTLGLNATWLVNSAAHMFGNRPYDQNINPRENPLVSVGALGEGFHNYHHTFPYDYSTSEFGWRENLT
Q9PW15    ILWVAYFVPTVLRYTLVLNATWLVNSAAHMFGNRPYDSTINPRENRFVTFSAIGEGFHNYHHTFPFDYSTSEYGWKLNLT
Q92038    SLWVAYFVPALLRYALVLNATWLVNSAAHMWGNRPYDSSINPRENRFVTFSAIGEGFHNYHHTFPFDYATSEFGCKLNLT
Q9PU86    SLWVAYFVPAVLRYALVLNATWLVNSAAHMWGNRPYDSSINPRENRFVAFSAIGEGFHNYHHTFPFDYATSEFGCKLNLT 330       340       350       360
          ....|....|....|....|....|....|....|
NOV10     T-WFIDFMCWLGLAIDRKRATKPMIEARKARTGDSSA---
CAC88580  T-WFIDFMCWLGLAIDRKRATKPMIEARKARTGDSSA---
Q9YGM2    T-AFIDLMCLLGLASDRKKVSKEVILARKMRTGDGSHKSG
Q9PW15    T-CFIDLMCELGLASDPKRVSREAVLARVQRTGDGSHRSG
Q92038    ICCFIDLMCELGLAREPKRVSREAVLARAQRTGDGSHWSG
Q9PU86    T-CFIDLMCFLGLAREPKRVSREAALARAQRTGDGSHRTG
```

BLAST analysis was performed on sequences from the Patp database, which is a proprietary database that contains sequences published in patents and patent publications. Patp results include those listed in Table 10E.

The ACYL-COA DESATURASE disclosed in this invention is expressed in at least the following tissues: Brain, adrenal gland, eye, retina, colon, ovary, testis.

TABLE 10E

Patp BLASTP Analysis for NOV10

| Sequences producing High-scoring Segment Pairs | Protein/Organisn | Length (aa) | Identity (%) | Positive (%) | E value |
|---|---|---|---|---|---|
| patp:AAG63225 | Amino acid sequence of a human lipid metabolism enzyme - *Homo sapiens* | 330 | 330/330 (100%) | 330/330 (100%) | 1.4e-183 |
| patp:AAG63850 | Amino acid sequence of human fatty acid desaturase 25934 - *Homo sapiens* | 330 | 330/330 (100%) | 330/330 (100%) | 1.4e-183 |
| patp:AAG63934 | Amino acid sequence of human fatty acid desaturase 25934 - *Homo sapiens* | 330 | 330/330 (100%) | 330/330 (100%) | 1.4e-183 |
| patp:AAY69378 | Amino acid sequence of human skin stearoyl-CoA desaturase - *Homo sapiens* | 359 | 187/284 (65%) | 234/284 (82%) | 2.1e-107 |
| patp:AAR25853 | MSH-dependent protein obtd. from hamster flank organ - *Mesocricetus auratus* | 354 | 181/284 (63%) | 233/284 (82%) | 3.Ee-105 |

Table 10I lists domain descriptions from pfam analysis for NOV10. This indicates that the NOV10 sequence has properties similar to those of other proteins known to contain these domains and similar to the properties of these domains.

The nucleic acids and proteins of the invention are useful in potential diagnostic and therapeutic applications implicated in various diseases and disorders described below and/or

TABLE 10F

Domain Analysis of NOV10

Pfam analysis

| Model | Domain | seq-f | seq-t | hmm-f | hmm-t | score | E-value |
|---|---|---|---|---|---|---|---|
| Desaturase | 1/1 | 51 | 295 | . . . 1 | 248 | [ ] 505.3 | 4.7e-148 |

Alignments of top-scoring domains:
Desaturase: domain 1 of 1, from 51 to 295: score 505.3, E = 4.7e-148
(SEQ ID NO:146)

```
                      illgalHlgAlyllallptelkwktvivalllYvitGlGITaGyHR
                      +|+++|||||  ]  +  |++ +|    |++|+++  + +  ||+|||+||
NOV10 (SEQ ID NO:362) 51 VLMSLLHLGAVYS-LVLIPKAKPLTLLWAYFCFLLAALGVTAGAHR 95

LwsHRSYkaklpLrifLaifgtlAvQgsiyeWardHRaHHkysDTdaDPH
                         |||||||+|||||||||| ++++|+|++|+||+|||||||||||+|||||
                      96 LWSHRSYRAKLPLRIFLAVANSMAFQNDIFEWSRDHRAHHKYSETDADPH 145 danRGFffSHvGWlLvkkhPavkekgkkldlsDLkaDpVvrFqhryYipl
                         +|+|||||||+||| |+||++|+|||+||||++|+||||| |++||++
                     146 NARRGFFFSHIGWLFVRKHRDVIEKGRKLDVTDLLADPVVRIQRKYYKIS 195 mvlmgfiLPtLvpgylwGetfwggfvwagflRlvfvlhaTWcVNSaAHkf
                         +|||+|++|||||+|  |||++|++++ |++||+++ |+  |+|||||++
                     196 VVLMCFVVPTLVPWYIWGESLWNSYFLASILRYTISLNISWLVNSAAHMY 245

GyrPyDsritPrnnwlvAlvtfGEGwHNfHHtFPyDYRnaekwkweyDlT
                         |+||||++|+||+|  ||||+++|||+|+|||||+||  ++|++   +++|
                     246 GNRPYDKHISPRQNPLVALGAIGEGFHNYHHTFPFDYSASEFG-LNFNPT 294 k<-*
                         +
                     295 T   295
``` other pathologies. For example, the compositions of the present invention will have efficacy for treatment of patients suffering from: Endometriosis, Fertility, Von Hippel-Lindau (VHL) syndrome, Alzheimer's disease, Stroke, Tuberous sclerosis, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain, Neuroprotection, Diabetes and other diseases, disorders and conditions of the like.

(OMIM 604031) Stearoyl-CoA desaturase (SCD; EC 1.14.99.5) is an iron-containing enzyme that catalyzes a rate-limiting step in the synthesis of unsaturated fatty acids. The principal product of SCD is oleic acid, which is formed by desaturation of stearic acid. The ratio of stearic acid to oleic acid has been implicated in the regulation of cell growth and differentiation through effects on cell-membrane fluidity and signal transduction. By RT-PCR of adipose tissue RNA with primers based on the sequence of rat SCD, a partial human SCD cDNA was isolated. Using RNase protection assays, it was recently found that human SCD was expressed at higher levels in colon and esophageal carcinomas than in the counterpart normal tissues. Additional cDNAs corresponding to the full-length human SCD transcript were cloned leading to 6 predicted amino acid changes. It was recently reported that the deduced 359-amino acid SCD protein contains the 3 highly conserved histidine-containing regions that are essential for the enzyme's catalytic activity. The coding region of human SCD shares 85% and 82% nucleotide identity with those of mouse Scd1 and Scd2, respectively. Northern blot analysis revealed that SCD is expressed ubiquitously as 3.9- and 5.2-kb mRNAs, with the highest levels in brain and liver. The 2 transcripts arise from use of alternative polyadenylation signals. It was demonstrated that the human SCD gene spans approximately 24 kb and contains 6 exons. They noted that the organization of the human, mouse, and rat SCD genes is very similar. By analysis of a somatic cell hybrid panel, the SCD gene was mapped to chromosome 10 and a transcriptionally inactive, processed SCD pseudogene to chromosome 17. Deletions were identified in the Scd1 gene in the asebia (ab) mutant mouse, which has rudimentary sebaceous glands and develops alopecia. Fatty acid desaturases (EC 1.14.99.-) are enzymes that catalyze the insertion of a double bond at the delta position of fatty acids.

There are two distinct families of fatty acid desaturases which do not seem to be evolutionary related. Family 1 is composed of: Stearoyl-CoA desaturase (SCD) (EC 1.14.99.5). SCD is a key regulatory enzyme of unsaturated fatty acid biosynthesis. SCD introduces a cis double bond at the delta(9) position of fatty acyl-CoA's such as palmitoleoyl- and oleoyl-CoA. SCD is a membrane-bound enzyme that is thought to function as a part of a multienzyme complex in the endoplasmic reticulum of vertebrates and fungi. Family 2 is composed of: Plants stearoyl-acyl-carrier-protein desaturase (EC 1.14.99.6), these enzymes catalyze the introduction of a double bond at the delta(9) position of steraoyl-ACP to produce oleoyl-ACP. This enzyme is responsible for the conversion of saturated fatty acids to unsaturated fatty acids in the synthesis of vegetable oils. Cyanobacteria desA an enzyme that can introduce a second cis double bond at the delta position of fatty acid bound to membranes glycerolipids. DesA is involved in chilling tolerance; the phase transition temperature of lipids of cellular membranes being dependent on the degree of unsaturation of fatty acids of the membrane lipids.

NOV11

A disclosed NOV11 nucleic acid of 1411 nucleotides (also referred to as CG50281-01) (SEQ ID NO:21) encoding a novel WNT-10B PROTEIN PRECURSOR-like protein is shown in Table 11A. An open reading frame was identified beginning with an ATG initiation codon at nucleotides 254–256 and ending with a TGA codon at nucleotides 1280–1282. Putative untranslated regions upstream from the initiation codon and downstream from the termination codon are underlined and the start and stop codons are in bold in Table 11A.

TABLE 11A

NOV11 nucleotide sequence (SEQ ID NO:21)
CAAGTGTTTGTGAGTCTGTGTGTCTGAGTTTGCAAGTGAGTGTGTGTCTG

TGTGCCGGGCGTTGTGTCTGATTGGGCAAGGTTCCAGGGGTGCTCGCTTG

AGTCCTGAGCTGGGACAACGCCTTGACTCTTCTTCTTTAAGACCTCCAAG

CCTCAGGGACTCTGGGAATCAAGGGGTGTTTCTTCTTGTTTTGTTTGAGG

AGGAATGAGAAGGGTCCTGATCGATCTGCCCACCGGAGCCTCCGGGCTTC

GACATGCTGGAGGAGCCCCGGCCGCGGCCTCCGCCCTCGGGCCTCGCGGG

TCTCCTGTTCCTGGCGTTGTGCAGTCGGGCTCTAAGCAATGAGATTCTGG

GCCTGAAGTTGCCTGGCGAGCCGCCGCTGACGGCCAACACCGTGTGCTTG

ACGCTGTCCGGCCTGAGCAAGCGGCAGCTAGGCCTGTGCCTGCGCAACCC

CGACGTCACGGCGTCCGCGCTTCAGGGTCTGCACATCGCGGTCCACGAGT

GTCAGCACCAGCTGCGCGACCAGCGCTGGAACTGCTCCGCGCTTGAGGGC

GGCGGCCGCCTGCCGCACCACAGCGCCATCCTCAAGCGCGGTTTCCGAGA

AAGTGCTTTTTCCTTCTCCATGCTGGCTGCTGGGGTCATGCACGCAGTAG

CCACGGCCTGCAGCCTGGGCAAGCTGGTGAGCTGTGGCTGTGGCTGGAAG

GGCAGTGGTGAGCAGGATCGGCTGAGGGCCAAACTGCTGCAGCTGCAGGC

ACTGTCCCGAGGGAAGGCTCCCCGGGACATCCAGGCACGAATGCGAATCC

ACAACAACAGGGTGGGCGCCAGGTGGTAACTGAAAACCTGAAGCGGAAA

TGCAAGTGTCATGGCACATCAGGCAGCTGCCAGTTCAAGACATGCTGGAG

GGCGGCCCCAGAGTTCCGGGCAGTGGGGCGGCGTTGAGGGAGCGGGTGG

GCCGGGCCATCTTCATTGATACCCACAACCGCAATTCTGGAGCCTTCCAG

CCCCGTCTGCGTCCCCGTCGCCTCTCAGGAGAGCTGGTCTACTTTGAGAA

GTCTCCTGACTTCTGTGAGCGAGACCCCACTATGGGCTCCCCAGGGACAA

GGGGCCGGGCCTGCAACAAGACCAGCCGCCTGTTGGATGGCTGTGGCAGC

CTGTGCTGTGGCCGTGGGCACAACGTGCTCCGGCAGACACGAGTTGAGCG

CTGCCATTGCCGCTTCCACTGGTGCTGCTATGTGCTGTGTGATGAGTGCA

AGGTTACAGAGTGGGTGAATGTGTGTAAGTGAGGGTCAACCTTACCTTGG

GGCTGGGGAAAAGGACTGTGTGAAAGGAAGCGCCTTTTCAACCCTTTGCT

ATGATTTCCTTCCAAGGTCACTCTTGGCCCCTGGAAGCTTAAAGATCTAC

CTGGAAAAAAC

The WNT-10B PROTEIN PRECURSOR-like NOV11 disclosed in this invention maps to chromosome 12.

In a search of sequence databases, it was found, for example, that the nucleic acid sequence of this invention has 641 of 654 bases (98%) identical to a gb:GENBANK-ID: HSU81787|acc:U81787.1 mRNA from Homo sapiens (Human Wnt10B mRNA, complete cds).

A disclosed NOV11 polypeptide (SEQ ID NO:22) encoded by SEQ ID NO:21 has 342 amino acid residues and is presented in Table 11B using the one-letter code. NOV11 polypeptides are likely Type Ib (Nexo Ccyt) membrane proteins. Analysis of NOV11 with INTEGRAL software predicts a likelihood of −3.88 of having a transmembrane domain at residues 157–173 (156–174). The SignalP, Psort and/or Hydropathy results predict that NOV11 has a signal peptide and is likely to be localized extracellularly with a certainty of 0.3700. In an alternative embodiment, NOV11 is likely to be localized to the lysosome (lumen) with a certainty of 0.1900, or to the endoplasmic reticulum (membrane) with a certainty of 0.1000, or to the endoplasmic reticulum (lumen) with a certainty of 0.1000. The most likely cleavage site for a NOV11 signal peptide is between amino acids 28 and 29, i.e., at the dash in the sequence ALS-NE.

TABLE 11B

NOV11 protein sequence (SEQ ID NO:22)
MLEEPRPRPPPSGLAGLLFLALCSRALSNEILGLKLPGEPPLTANTVCLT

LSGLSKRQLGLCLRNPDVTASALQGLHIAVHECQHQLRDQRWNCSALEGG

GRLPHHSAILKRGFRESAFSFSMLAAGVMHAVATACSLGKLVSCGCGWKG

SGEQDRLRAKLLQLQALSRGKAPRDIQARMRIHNNRVGRQVVTENLKRKC

KCHGTSGSCQFKTCWRAAPEFRAVGAALRERVGRAIFIDTHNRNSGAFQP

RLRPRRLSGELVYFEKSPDFCERDPTMGSPGTRGRACNKTSRLLDGCGSL

CCGRGHNVLRQTRVERCNCRFHWCCYVLCDECKVTEWVNVCK

The full amino acid sequence of the protein of the invention was found to have 171 of 176 amino acid residues (97%) identical to, and 173 of 176 amino acid residues (98%) similar to, the 389 amino acid residue ptnr:SWISSPROT-ACC:O00744 protein from *Homo sapiens* (Human) (WNT-10B PROTEIN PRECURSOR (WNT-12)).

In a search of public sequence databases, NOV11 was found to have homology to the amino acid sequences shown in the BLASTP data listed in Table 11C.

TABLE 11C

BLASTP results for NOV11

| Gene Index/ Identifier | Protein/Organism | Length (aa) | Identity (%) | Positives (%) | Expect |
|---|---|---|---|---|---|
| ptnr:TREMBLNEW-ACC:BAB72181 | WNT10B - *Homo sapiens* | 389 | 171/176 (97%) | 173/176 (98%) | 4.5e-189 |
| ptnr:SWISSPROT-ACC:O00744 | WNT-10B protein precursor (WNT-12) - *Homo sapiens* | 389 | 171/176 (97%) | 173/176 (98%) | 2.5e-188 |
| ptnr:SWISSPROT-ACC:P48614 | WNT-10B protein precursor (WNT-12) - *Mus musculus* | 389 | 168/176 (95%) | 172/176 (97%) | 9.8e-185 |
| ptnr:SPTREMBL-ACC:P79753 | WNT10B - *Fugu rubripes* (Japanese pufferfish) (Takifugu rubripes) | 390 | 123/208 (59%) | 154/208 (74%) | 2.5e-119 |
| ptnr:SWISSPROT-ACC:P70701 | WNT-10A protein precursor - *Mus musculus* | 417 | 119/182 (65%) | 136/182 (74%) | 2.0e-117 |

A multiple sequence alignment is shown in Table 11D, with the protein of the invention being shown on the first line in a ClustalW analysis comparing the protein of the invention with related protein sequences shown in Table 11C.-

Table 11D. ClustalW Analysis of NOV11

1) NOV11 CG50281-01 (SEQ ID NO:22)
2) BAB72181 (SEQ ID NO:147)
3) O00744 (SEQ ID NO:148)
4) P48614 (SEQ ID NO:149)
5) P79753 (SEQ ID NO:150)
6) P70701 (SEQ ID NO:151)

```
                 10        20        30        40        50        60        70        80
            ....|....|....|....|....|....|....|....|....|....|....|....|....|....|....|....|
NOV11       --------MLEEPR-PRPPPSGLAGLLFLALCSRALS----NEILGLKLPGEPPLTANTVCLTLSGLSKRQLGLCLRNPD
BAB72181    --------MLEEPR-PRPPPSGLAGLLFLALCSRALS----NEILGLKLPGEPPLTANTVCLTLSGLSKRQLGLCLRNPD
O00744      --------MLEEPR-PRPPPSGLAGLLFLALCSRALS----NEILGLKLPGEPPLTANTVCLTLSGLSKRQLGLCLRNPD
P48614      --------MLEEPR-SRPPPLGLAGLLFLALFSRALS----NEILGLKLPGEPPLTANTVCLTLSGLSKRQLGLCLRSPD
P79753      ---------MEPPH---KFRWDKFLILATALMSPAFT-VLCNDILSLKVAGEPVLTPNSVCLKLAGLSKRQMRMCVRSPD
P70701      MGSAHPRPWLRLPQGPQPREFWALLFFLLLAAAVPRSAPNDILGLRLPPEEVLNANTVCLTLPGLSRROMEVCVRHPD 90       100       110       120       130       140       150       160
            ....|....|....|....|....|....|....|....|....|....|....|....|....|....|....|....|
NOV11       VTASALQGLHIAVHECQHQLRDQRWNCSALEGGGRLPHHSAILKRGFRESAFSFSMLAAGVMHAVATACSLGKLVSCGCG
BAB72181    VTASALQGLHIAVHECQHQLRDQRWNCSALEGGGRLPHHSAILKRGFRESAFSFSMLAAGVMHAVATACSLGKLVSCGCG
O00744      VTASALQGLHIAVHECQHQLRDQRWNCSALEGGGRLPHHSAILKRGFRESAFSFSMLAAGVMHAVATACSLGKLVSCGCG
P48614      VTASALQGLHIAVHECQHQLRDQRWNCSALEGGGRLPHHSAILKRGFRESAFSFSMLAAGVMHAVATACSLGKLVSCGCG
P79753      ATASALQGIQVATHECQYQLRDQRWNCSSLEGL-GKLPHENTILNRGFRESAFSLAMLAAGVA-SVASACSYGKLRGCGCE
P70701      VAASAIQGIQIATHECQHCFRDQRWNCSSLETRNKVPYESPIFSRGFRESA-AYAIAAAGVVHAVSNACALGKLKACGCD 170       180       190       200       210       220       230       240
            ....|....|....|....|....|....|....|....|....|....|....|....|....|....|....|....|
NOV11       WKGSGEQDRLRAKL--LQLQALSRGK---------------------------------------------APRDIQA
BAB72181    WKGSGEQDRLRAKL--LQLQALSRGKSFPHSLPSPGPGSSPSPGPQDTWEWGGCNHDYDFGEKFSRDFLDSREAPRDIQA
O00744      WKGSGEQDRLRAKL--LQLQALSRGKSFPHSLPSPGPGSSPSPGPQDTWEWGGCNHDYDFGEKFSRDFLDSREAPRDIQA
P48614      WKGSGEQDRLRAKL--LQLQALSRGKTFPISQPSPVPGSVPSPGPQDTWEWGGCNHDYDFGEKFSRDFLDSREAPRDIQA
P79753      AKRRQDDDKIRLKLTQLQLQSLQKDD-LS--------------SMQETWEWGGCSHDVRYGDRFSRDWLDSRGSPRDIHA
P70701      ASRRGDEEAFRRKLHRQLDALQRGKGLSHGVPEHPAILPASPGLQDSWEWGGCSPDVGFGERFSKDFLDSREPHRDIHA 250       260       270       280       290       300       310       320
            ....|....|....|....|....|....|....|....|....|....|....|....|....|....|....|....|
NOV11       RMRIHNNRVGRQVVTENLKRKCKCHGTSGSCQFKTCWRAAPEFRAVGAALRERVGRAIFIDTHNRNSGAFQPR-------
BAB72181    RMRIHNNRVGRQVVTENLKRKCKCHGTSGSCQFKTCWRAAPEFRAVGAALRERVGRAIFIDTHNRNSGAFQPR-------
O00744      RMRIHNNRVGRQVVTENLKRKCKCHGTSGSCQFKTCWRAAPEFRAVGAALRERIGRAIFIDTHNRNSGAFQPR-------
P48614      RMRIHNNRVGRQVVTENLKRKCKCHGTSGSCQFKTCWRAAPEFRATGAALRERISRAIFIDTHNRNSGAFQPR-------
```

```
P79753    RMKIHNNRVGRCIVTDNMKRKCKCHGTSGSCQFQTCWHVSPEFRLVGSLLKEKFLSAILVNSQNKNNGVENPRIGSGVSG
P70701    RMRLHNNRVGRCAVMENVRRKCKCHGTSGSCQLKTCWQVTPEFRTVGALLRNRFHRATLIRPHNRGGQLEPGP-AGAPS 330       340       350       360       370       380       390       400
              ....|....|....|....|....|....|....|....|....|....|....|....|....|....|....|
NOV11     ------LRPRRLSGELVYFEKSPDFCERDPTMGSPGTRGRACNKTSRLLDGCGSLCCGRGHNVLRQTRVERCHCRFHWC
BAB72181  ------LRPRRLSGELVYFEKSPDFCERDPTMGSPGTRGRACNKTSRLLDGCGSLCCGRGHNVLRQTRVERCHCRFHWC
O00744    ------LRPRRLSGELVYFEKSPDFCERDPTMGSPGTRGRACNKTSRLLDGCGSLCCGRGHNVLRQTRVERCHCRFHWC
P48614    ------LRPRRLSGELVYFEKSPDFCERDPTMGSPGTRGRACNKTSRLLDGCGSLCCGRGHNVLRQTRVERCHCRFHWC
P79753    STGGLNGGRRRSMSRELVYFEKSPDFCEPNLSVDSAGTQGRICNKTSQSTDSCGSLCCGRGHNILKKTHSERCNCRFHWC
P70701    PAPGTPGLRRRASHSDLVYFEKSPDFCEREPRLDSAGTVGRLCNKSSTGPDGCGSMCCGRGHNILROTRSERCHCRFHWC

410
              ....|....|....|...
NOV11     CYVLCDECKVTEWVNVCK
BAB72181  CYVLCDECKVTEWVNVCK
O00744    CYVLCDECKVTEWVNVCK
P48614    CYVLCDECKVTEWVNVCK
P79753    CYVLCEECRLTEWVNVCK
P70701    CFVVCEECRITEWVSVCK
```

Other BLAST results include sequences from the Patp database, which is a proprietary database that contains sequences published in patents and patent publications. Patp results include those listed in Table 11E.

TABLE 11E

Patp BLASTP Analysis for NOV11

| Sequences producing High-scoring Segment Pairs | Protein/Organism | Length (aa) | Identity (%) | Positive (%) | E Value |
|---|---|---|---|---|---|
| patp:AAW08928 | Wnt-10b protein - *Homo sapiens* | 389 | 171/176 (97%) | 173/176 (98%) | 4.6e-187 |
| patp:AAR53689 | HR2 polypeptide - *Homo sapiens* | 389 | 168/176 (95%) | 172/176 (97%) | 7.6e-185 |
| patp:AAY94319 | Murine Wnt-10A protein - *Mus musculus* | 417 | 119/182 (65%) | 136/182 (74%) | 1.6e-117 |
| patp:AAY28559 | Wnt-10a polypeptide #1 - *Homo sapiens* | 417 | 119/182 (65%) | 137/182 (75%) | 4.1e-117 |
| patp:AAB95835 | Human protein sequence SEQ ID NO:18862 - *Homo sapiens* | 417 | 119/182 (65%) | 137/182 (75%) | 2.3e-116 |

Table 11F lists the domain description from DOMAIN analysis results against NOV11.

```
P79753    RMKIHNNRVGRCLVTDNMKRKCKCHGTSGSCQFQTCWHVSPEFRLVGSLLKEKFLSAILVNSQNKNNGVFNPRIGSGVSG
P70701    RMRLHNNRVGRCAVMENMRRKCKCHGTSGSCCLKTCWQVTPEFRTVGALLRNRFHRATLIRPHNRGGQLEPGP-AGAPS 330       340       350       360       370       380       390       400
              ....|....|....|....|....|....|....|....|....|....|....|....|....|....|....|
NOV11     -------LRPRRLSGELVYFEKSPDFCERDPTMGSPGTRGRACNKTSRLLDGCGSLCCGRGHNVLRQTRVERCHCRFHWC
BAB72181  -------LRPRRLSGELVYFEKSPDFCERDPTMGSPGTRGRACNKTSRLLDGCGSLCCGRGHNVLRQTRVERCHCRFHWC
000744    -------LRPRRLSGELVYFEKSPDFCERDPTMGSPGTRGRACNKTSRLLDGCGSLCCGRGHNVLRQTRVERCHCRFHWC
P48614    -------LRPRRLSGELVYFEKSPDFCERDPTMGSPGTRGRACNKTSRLLDGCGSLCCGRGHNVLRQTRVERCHCRFHWC
P79753    STGGLNGGRRRSMSRELVYFEKSPDFCEPNLSVDSAGTQGRICNKTSQSTDSCGSLCCGRGHNILKKTHSERCNCRFHWC
P70701    PAPGTPGLRRRASHSDLVYFEKSPDFCEREPRLDSAGTVGRLCNKSSTGPDGCGSMCCGRGHNILRQTRSERCHCRFHWC

410
              ....|....|....|...
NOV11     CYVLCDECKVTEWVNVCK
BAB72181  CYVLCDECKVTEWVNVCK
000744    CYVLCDECKVTEWVNVCK
P48614    CYVLCDECKVTEWVNVCK
P79753    CYVLCEECRITEWVNVCK
P70701    CEVMCEECRITEWVSVCK
```

```
(SEQ ID NO:152)              lCrslPGLsprQrqlCrrnpdvmasvseGaqLaiqECQhQFRgrRWN
                             +| +| |·||+||+ || |||||+||
+|+++|++||||| | |||
     NOV11    (SEQ ID NO:363) 47
VCLTLSGLSKRQLGLCLRNPDVTASALQGLHIAVHECQHQLRDQRWN 93

CStldslnersvfgkvlkkgtREtAFVyAIsSAGVahaVTRaCseGeles
                  ||+|++    +   + +||+|+||+||  ++  +|||+|||+ ||| |+| |
              94  CSALEGGGRLPHHSAILKRGFRESAFSFSMLAAGVMHAVATACSLGKLVS 143

CGCDdkRkadeerlrikL<-*
                  |||+ |  ++ +||| ||
              144 CGCGWKGSGEQDRLRAKL     161

Metallothio_2: domain 1 of 1, from 142 to 214: score -33.6, E = 7.4
  (SEQ ID NO:153)            MSCsCGGnCGCGSgCkCGsGCgGCkmYpdlsettssttteatTlvlG
                             ||+|| +   ||| +   + + +
||    +       +
    NOV11    (SEQ ID NO:364) 142   VSCGCGWK---GSGEQDRLRAK-LLQLQALSRGK---APR---
---D 175

VAPekkaqfegsEmgvavaaeenGCKC.GsnCkCdPCNC<-*
                  + + + +  + |+++    |||+|++  |  +|
              176 IQARMRIHNNRVGRQVVTENLKRKCKChGTSGSCQFKTC    214 wnt: domain 2 of 2, from 174 to 342: score 292.7, E = 4.5e-106
  (SEQ ID NO:154)          rdrdaRsLMNLHNNEAGRkaVkshmrreCKCHGvSGSCslKTCWlsL
                           || + ++|++|||++||++|
++++|+|||||+|||+ ||||++
    NOV11    (SEQ ID NO:365) 174   RD--
IQARMRIHNNRVGRQVVTENLKRKCKCHGTSGSCQFKTCWRAA 218

PdFReVGdlLKeKYdgAieVevnkrgkgqrslssrkqasaleaanerfkk
                  |+||+||++|+|+    || +  ++|++|            |+ ++ + ++
              219 PEFRAVGAALRERVGRAIFIDTHNRNSG-----------AFQPRLRPRR- 256

PtrnQYTDLVYlEkSPDYCerdretGslGTqGRvCnktSkGlqWRDgCel
                  +|||+|||||+|||+   ||+||+|+|||||+ |   |||++
              257 -LSG---ELVYFEKSPDFCERDPTMGSPGTRGRACNKTSRLL---DGCGS 299

LCCGRGYnteqKvertekCnCkFHNGWCCyVkCeeCtevvevhtCK<-*
                  ||||||+|++  ++|+|+|+|||   ||||| |+||+ +++| +||
              300 LCCGRGHNVLR-QTRVERCHCRFH--WCCYVLCDECKVTEWVNVCK   342
```

The WNT-10B PROTEIN PRECURSOR-Like protein disclosed in this invention is expressed in at least the following tissues: Melanocytes, heart, uterus, brain, lung, testis, b-cell, ovary. This information was derived by determining the tissue sources of the sequences that were included in the invention including but not limited to Seq-Calling sources, Public EST sources, Literature sources, and/or RACE sources.

The nucleic acids and proteins of the invention are useful in potential diagnostic and therapeutic applications implicated in various diseases and disorders described below and/or other pathologies. For example, the compositions of the present invention will have efficacy for treatment of patients suffering from: neurodegenerative disorders, epilepsy, cancers including but not limited to brain tumor, colon cancer and breast cancer, developmental disorders, and neural tube defects and other diseases, disorders and conditions of the like.

WNT genes encode intercellular signaling glycoproteins that play important roles in key processes of embryonic development such as mesoderm induction, specification of the embryonic axis, and patterning of the central nervous system, spinal cord, and limbs. The name WNT denotes the relationship of this family to the *Drosophila* segment polarity gene 'wingless,' and to its vertebrate ortholog Intl, a mouse protooncogene. It was noted that multiple WNT genes are known to exist in several species that have been investigated ranging from *Drosophila* to man. They have been classified into various groups and subgroups on the basis of high sequence homology and common expression patterns.

The vertebrate WNT8 subfamily includes genes from *Xenopus*, zebrafish, and chicken; the first mammalian WNT8 homolog, a human member of the Wnt8 family that they termed WNT8B was characterized on the basis of the very high sequence similarity (90–91% identity) of the inferred protein to those encoded by the *Xenopus* and zebrafish Wnt8b genes. The human cDNA encodes a 295-amino acid polypeptide that contains a C2H2 zinc finger-like motif. A predominant 1.9-kb mRNA was detected in a variety of adult and fetal tissues. They used PCR typing of a human monochromosomal hybrid cell panel to map the gene to chromosome 10, and fluorescence in situ hybridization for localization at 10q24. Recently, the full-length cDNA sequence and genomic organization of the human WNT8B gene was reported along with studies of expression of the gene in human and mouse embryos. The WNT8B gene contains 6 exons separated by small introns, with the exception of intron 1. The predicted protein has 351 amino acids. The gene is expressed predominantly as a transcript of approximately 2.1 kb. The human and mouse expression patterns appeared to be identical and were restricted to the developing brain, with the great majority of expression being found in the developing forebrain. In the latter case, expression was confined to the germinative neuroepithelium of 3 sharply delimited regions: the dorsomedial wall of the telencephalic ventricles (which includes the developing hippocampus), a discrete region of the dorsal thalamus, and the mammillary and retromammillary regions of the posterior hypothalamus. Expression in the developing hippocampus may suggest a role for WNT8B in patterning of this region, and subchromosomal localization of the human gene to 10q24 may suggest it as a candidate gene for partial epilepsy (EPT; OMIM-600512) in families in which the disease has been linked to markers in this region. WNT1 (OMIM-164820) is a member of a family of cysteine-rich, glycosylated signaling proteins that mediate diverse developmental processes such as the control of cell proliferation, adhesion, cell polarity, and the establishment of cell fates.

Wnt1 was identified as an oncogene activated by the insertion of mouse mammary tumor virus in virus-induced mammary adenocarcinomas. Although Wnt1 is not expressed in the normal mammary gland, expression of Wnt1 in transgenic mice causes mammary tumors. To identify downstream genes in the WNT signaling pathway that are relevant to the transformed cell phenotype, a PCR-based cDNA subtraction strategy and suppression subtractive hybridization was used. Two genes, WISP1 and WISP2 (OMIM-603399), were identified that are upregulated in the mouse mammary epithelial cell line transformed by Wnt1, but not by Wnt4 (OMIM-603490). Together with a third related gene, WISP3 (OMIM-603399), these proteins define a subfamily of the connective tissue growth factor family. Two distinct systems demonstrated WISP induction to be associated with the expression of WNT1. WISP1 genomic DNA was amplified in colon cancer cell lines and in human colon tumors and its RNA overexpressed in 84% of the tumors examined compared with patient-matched normal mucosa. WISP3 also was overexpressed in 63% of colon tumors analyzed. In contrast, WISP2 showed reduced RNA expression in 79% of the tumors. These results suggested that WISP genes may be downstream of WNT1 signaling and that aberrant levels of WISP expression in colon cancer may play a role in colon tumorigenesis. It was found that the WISP1 cDNA encodes a 367-amino acid protein. Mouse and human WISP1 proteins are 84% identical; both have hydrophobic N-terminal signal sequences, 38 conserved cysteine residues, and 4 potential N-linked glycosylation sites. Alignment of the 3 human WISP proteins showed that WISP1 and WISP3 are most similar (42%), whereas WISP2 had 37% identity with WISP1 and 32% identity with WISP3.

Several members of the Wnt gene family have been shown to cause mammary tumors in mice. Using degenerate primer PCR on human genomic DNA and specific PCR of cDNA libraries, a Wnt gene was isolated that had not previously been described in human. It is the human homolog of mouse Wnt10b, which had been shown to be one of the oncogenes cooperating with FGF3 in the development of mouse mammary tumor virus (MMTV)-induced mammary carcinomas in mice. The human WNT10B sequence is 88 and 95% identical to the murine gene at nucleotide and amino acid levels, respectively. By YAC and fluorescence in situ hybridization (FISH) mapping, the gene was localized to 12q13, a chromosomal region frequently rearranged in human tumors and also containing the WNT1 gene. WNT10B expression was not observed in normal and benign proliferations of human breast tissue but was found to be elevated in 3 of 50 primary breast carcinomas. Southern blot analysis of the carcinoma expressing the highest level of WNT10B showed no amplification or rearrangement of the gene. It was recently demonstrated that the WNT10B gene encodes a 389-amino acid protein with 96.6% sequence identity to mouse Wnt10b. The expression pattern showed that it is synthesized in many adult tissues with the highest levels found in heart and skeletal muscle. By PCR typing of a human/rodent monochromosomal panel and FISH, they mapped WNT10B to 12q13.1. It was recently shown that WNT signaling, likely mediated by WNT10B, is a molecular switch that governs adipogenesis. WNT signaling maintains preadipocytes in an undifferentiated state through inhibition of the adipogenic transcription factors CEBPA and PPAR-gamma. When WNT signaling in preadipocytes is prevented by overexpression of axin or dominant-negative TCF4, these cells differentiate into adipocytes. Disruption of WNT signaling also causes transdifferentiation of myoblasts into adipocytes in vitro, highlighting the importance of this pathway not only in adipocyte differentiation but also in mesodermal cell fate determination.

NOV12

NOV112 includes two novel Kilon Protein Precursor-like proteins disclosed below. The disclosed sequences have been named NOV12a and NOV12b. Unless specifically addressed as NOV12a or NOV12b, any reference to NOV12 is assumed to encompass all variants.

NOV12a

A disclosed NOV12a nucleic acid of 1196 nucleotides (also referred to as CG55920-01) (SEQ ID NO:23) encoding a novel Kilon Protein Precursor-like protein is shown in Table 12A. An open reading frame was identified beginning with an ATG initiation codon at nucleotides 94–96 and ending with a TAA codon at nucleotides 1156–1158. Putative untranslated regions upstream from the initiation codon and downstream from the termination codon are underlined and the start and stop codons are in bold in Table 12A.

TABLE 12A

NOV12a nucleotide sequence (SEQ ID NO:23)

GCGCGCCGCCTGGTTCCCGGGAAGACTCGCCAGCACCAGGGGGTGGGGGA

GTGCGAGCTGAAAGCTGCTGGAGAGTGAGCAGCCCTAGCAGGGATGGACA

TGATGCTGTTGGTGCAGGGTGCTTGTTGCTCGAACCAGTGGCTGGCGGCG

GTGCTCCTCAGCCTGTGCTGCCTGCTACCCTCCTGCCTCCCGGCTGGACA

GAGTGTGGACTTCCCCTGGGCGGCCGTGGACAACATGATGGTCAGAAAAG

GGGACACGGCGGTGCTTAGGTGTTATTTGGAAGATGGAGCTTCAAAGGGT

GCCTGGCTGAACCGGTCAAGTATTATTTTTGCGGGAGGTGATAAGTGGTC

AGTGGATCCTCGAGTTTCAATTTCAACATTGAATAAAAGGGACTACAGCC

TCCAGATACAGAATGTAGATGTGACAGATGATGGCCCATACACGTGTTCT

GTTCAGACTCAACATACACCCAGAACAATGCAGGTGCATCTAACTGTGCA

AGTTCCTCCTAAGATATATGACATCTCAAATGATATGACCGTCAATGAAG

GAACCAACGTCACTCTTACTTGTTTGGCCACTGGGAAACCAGAGCCTTCC

ATTTCTTGGCGACACATCTCCCCATCAGCAAAACCATTTGAAAATGGACA

ATATTTGGACATTTATGGAATTACAAGGGACCAGGCTGGGGAATATGAAT

GCAGTGCGGAAAATGATGTGTCATTCCCAGATGTGAGGAAAGTAAAAGTT

GTTGTCAACTTTGCTCCTACTATTCAGGAAATTAAATCTGGCACCGTGAC

CCCCGGACGCAGTGGCCTGATAAGATGTGAAGGTGCAGGTGTGCCGCCTC

CAGCCTTTGAATGGTACAAAGGAGAGAAGAAGCTCTTCAATGGCCAACAA

GGAATTATTATTCAAAATTTTAGCACAAGATCCATTCTCACTGTTACCAA

CGTGACACAGGAGCACTTCGGCAATTATACTTGTGTGGCTGCCAACAAGC

TAGGCACAACCAATGCGAGCCTGCCTCTTAACCCTCCAAGTACAGCCCAG

TATGGAATTACCGGGAGCGCTGATGTTCTTTTCTCCTGCTGGTACCTTGT

GTTGACACTGTCCTCTTTCACCAGCATATTCTACCTGAAGAATGCCATTC

TACAATAAATTCAAAGACCCATAAAAGGCTTTTAAGGATTCTCTGA

The KILON PROTEIN PRECURSOR-like NOV12a disclosed in this invention maps to chromosome 1.

In a search of sequence databases, it was found, for example, that the nucleic acid sequence of this invention has 1003 of 1167 bases (85%) identical to a gb:GENBANK-ID: AB07139|acc:AB07139.1 mRNA from *Rattus norvegicus* (*Rattus norvegicus* mRNA for Kilon, complete cds).

A disclosed NOV12a polypeptide (SEQ ID NO:24) encoded by SEQ ID NO:23 has 354 amino acid residues and is presented in Table 12B using the one-letter code. The Psort and Hydropathy results predict that this sequence has a signal peptide and is likely to be localized extracellularly with a certainty of 0.8200. In an alternative embodiment, NOV12a is likely to be localized to the lysosome (lumen) with a certainty of 0.5088, or to the endoplasmic reticulum (membrane) with a certainty of 0.1000, or to the endoplasmic reticulum (lumen) with a certainty of 0.1000. Most likely cleavage site for a NOV12a signal peptide is between pos. 33 and 34, i.e., at the dash in the sequence CLP-AG.

TABLE 12B

NOV12a protein sequence (SEQ ID NO:24)
MDMMLLVQGACCSNQWLAAVLLSLCCLLPSCLPAGQSVDFPWAAVDNMMV

RKGDTAVLRCYLEDGASKGAWLNRSSIIFAGGDKWSVDPRVSISTLNKRD

YSLQIQNVDVTDDGPYTCSVQTQHTPRTMQVHLTVQVPPKIYDISNDMTV

NEGTNVTLTCLATGKPEPSISWRHISPSAKPFENGQYLDIYGITRDQAGE

YECSAENDVSFPDVRKVKVVVNFAPTIQEIKSGTVTPGRSGLIRCEGAGV

PPPAFEWYKGEKKLFNGQQGIIIQNFSTRSILTVTNVTQEHFGNYTCVAA

NKLGTTNASLPLNPPSTAQYGITGSADVLFSCWYLVLTLSSFTSIFYLKN

AILQ

The full amino acid sequence of the protein of the invention was found to have 334 of 352 amino acid residues (94%) identical to, and 341 of 352 amino acid residues (96%) similar to, the 348 amino acid residue ptnr:SWIS-SPROT-ACC:Q9Z0J8 protein from *Rattus norvegicus* (Rat) (KILON PROTEIN PRECURSOR (KINDRED OF IGLON)).

The NOV12a disclosed in this invention is expressed in at least the following tissues: brain. The nucleic acids and proteins of the invention are useful in potential diagnostic and therapeutic applications implicated in various diseases and disorders described below and/or other pathologies. For example, the compositions of the present invention will have efficacy for treatment of patients suffering from: Von Hippel-Lindau (VHL) syndrome, Alzheimer's disease, Stroke, Tuberous sclerosis, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain, Neuroprotection and other diseases, disorders and conditions of the like.

NOV12b

A disclosed NOV12b nucleic acid of 1165 nucleotides (also referred to as CG55920-04) (SEQ ID NO:25) encoding a novel Kilon Protein Precursor-like protein is shown in Table 12C. An open reading frame was identified beginning with an ATG initiation codon at nucleotides 77–79 and ending with a TAA codon at nucleotides 1139–1141. Putative untranslated regions upstream from the initiation codon and downstream from the termination codon are underlined and the start and stop codons are in bold in Table 12C.

TABLE 12C

NOV12b nucleotide sequence (SEQ ID NO:25)
CGGGAAGACTCGCCAGCACCTGGGGGTGGGGGAGTGCGAGCTGAAAGCTG

CTGGAGAGTGAGCAGCCCTAGCAGGGATGGACATGATGCTGTTGGTGCAG

AGTGCCTGTTGCTCGAACCAGCGGCTGGCGGCGGTGCTTCTCAGCCTGTG

CTGCCTGCTACCCTCCTGCCTCCCGGCTGGACAGAGTGTGGACTTCCCCT

GGGCGGCCGTGGACAACATGATGGTCAGAAAAGGGGACACGGCGGTGCTT

AGGTGTTATTTGGAAGATGGAGCTTCAAAGGGTGCCTGGCTGAACCGGTC

AAGTATTATTTTTGCGGGAGGTGATAAGTGGTCAGTGGATCCTCGAGTTT

CAATTTCAACATTGAATAAAAGGGACTACAGCCTCCAGATACAGAATGTA

GATGTGACAGATGATGGCCCATACACGTGTTCTGTTCAGACTCAACATAC

ACCCAGAACAATGCAGGTGCATCTAACTGTGCAAGTTCCTCCTAAGATAT

ATGACATCTCAAATGATATGACCGTCAATGAAGGAACCAACGTCACTCTT

ACTTGTTTGGCCACTGGGAAACCAGAGCCTTCCATTTCTTGGCGACACAT

CTCCCCATCAGCAAAACCATTTGAAAATGGACAATATTTGGACATTTATG

GAATTACAAGGGACCAGGCTGGGGAATATGAATGCAGTGCGGAAAATGAT

GTGTCATTCCCAGATGTGAGGAAAGTAAAAGTTGTTGTCAACTTTGCTCC

TACTATTCAGGAAATTAAATCTGGCACCGTGACCCCCGGACGCAGTGGCC

TGATAAGATGTGAAGGTGCAGGTGTGCCGCCTCCAGCCTTTGAATGGTAC

AAAGGAGAGAAGAAGCTCTTCAATGGCCAACAAGGAATTATTATTCAAAA

TTTTAGCACAAGATCCATTCTCACTGTTACCAACGTGACACAGGAGCACT

TCGGCAATTATACTTGTGTGGCTGCCAACAAGCTAGGCACAACCAATGCG

AGCCTGCCTCTTAACCCTCCAAGTACAGCCCAGTATGGAATTACCGGGAG

CGCTGATGTTCTTTTCTCCTGCTGGTACCTTGTGTTGACACTGTCCTCTT

TCACCAGCATATTCTACCTGAAGAATGCCATTCTACAATAAATTCAAAGA

CCCATAAAAGGCTTT

The KILON PROTEIN PRECURSOR-like NOV12b disclosed in this invention maps to chromosome 1.

In a search of sequence databases, it was found, for example, that the nucleic acid sequence of this invention has 989 of 1154 bases (85%) identical to a gb:GENBANK-ID: AB017139|acc:AB017139.1 mRNA from *Rattus norvegicus* (*Rattus norvegicus* mRNA for Kilon, complete cds).

A disclosed NOV12b polypeptide (SEQ ID NO:26) encoded by SEQ ID NO:25 has 354 amino acid residues and is presented in Table 12B using the one-letter code. NOV12b seems to be a Type II (Ncyt Cexo) membrane protein with an INTEGRAL Likelihood of −5.41 Transmembrane 17–33 (15–36). The Psort and Hydropathy results predict that this sequence has a signal peptide and is likely to be localized at the Golgi body with a certainty of 0.9000. In an alternative embodiment, NOV12b is likely to be localized to the mitochondrial inner membrane with a certainty of 0.8084, or to the plasma membrane with a certainty of 0.6500, or to the mitochondrial intermembrane space with a certainty of 0.4883. Most likely cleavage site for a NOV12b signal peptide is between pos. 33 and 34, i.e., at the dash in the sequence CLP-AG.

TABLE 12D

NOV12b protein sequence (SEQ ID NO:26)
MDMMLLVQSACCSNQRLAAVLLSLCCLLPSCLPAGQSVDFPWAAVDNMMV

RKGDTAVLRCYLEDGASKGAWLNRSSIIFAGGDKWSVDPRVSISTLNKRD

YSLQIQNVDVTDDGPYTCSVQTQHTPRTMQVHLTVQVPPKIYDISNDMTV

NEGTNVTLTCLATGKPEPSISWRHISPSAKPFENGQYLDIYGITRDQAGE

YECSAENDVSFPDVRKVKVVVNFAPTIQEIKSGTVTPGRSGLIRCEGAGV

PPPAFEWYKGEKKLFNGQQGIIIQNFSTRSILTVTNVTQEHFGNYTCVAA

NKLGTTNASLPLNPPSTAQYGITGSADVLFSCWYLVLTLSSFTSIFYLKN

AILQ

The full amino acid sequence of the protein of the invention was found to have 332 of 352 amino acid residues (94%) identical to, and 339 of 352 amino acid residues (96%) similar to, the 348 amino acid residue ptnr:SWISSPROT-ACC:Q9Z0J8 protein from *Rattus norvegicus* (Rat) (KILON PROTEIN PRECURSOR (KINDRED OF IGLON)).

The KILON PROTEIN PRECURSOR-like gene disclosed in this invention is expressed in at least the following tissues: brain. The nucleic acids and proteins of the invention have applications in the diagnosis and/or treatment of various diseases and disorders. For example, the compositions of the present invention will have efficacy for the treatment of patients suffering from: Von Hippel-Lindau (VHL) syndrome, Alzheimer's disease, Stroke, Tuberous sclerosis, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain, Neuroprotection, as well as other diseases, disorders and conditions.

NOV12a and NOV12b share a high degree of homology as is shown in the amino acid alignment in Table 12E.

Table 12E. Clustal W Alignment of NOV12a and NOV12b

```
                 10        20        30        40        50        60        70        80
             ....|....|....|....|....|....|....|....|....|....|....|....|....|....|....|....|
CG55920_01   MDMMLLVQGACCSNCWLAAVLLSLCCLLPSCLPAGQSVDFPWAAVDNMMVRKGDTAVLRCYLEDGASKGAWLNRSSIIFA
CG55920_04   MDMMLLVQSACCSNCRLAAVLLSLCCLLPSCLPAGQSVDFPWAAVDNMMVRKGDTAVLRCYLEDGASKGAWLNRSSIIFA 90       100       110       120       130       140       150       160
             ....|....|....|....|....|....|....|....|....|....|....|....|....|....|....|....|
CG55920_01   GGDKWSVDPRVSISTLNKRDYSLQIQNVDVTDDGPYTCSVQTQHTPRTMQVHLTVQVPPKIYDISNDMTVNEGTNVTLTC
CG55920_04   GGDKWSVDPRVSISTLNKRDYSLQIQNVDVTDDGPYTCSVQTQHTPRTMQVHLTVQVPPKIYDISNDMTVNEGTNVTLTC 170       180       190       200       210       220       230       240
             ....|....|....|....|....|....|....|....|....|....|....|....|....|....|....|....|
CG55920_01   LATGKPEPSISWRHISPSAKPFENGQYLDIYGITRDQAGEYECSAENDVSFPDVRKVKVVVNFAPTIQEIKSGTVTPGRS
CG55920_04   LATGKPEPSISWRHISPSAKPFENGQYLDIYGITRDQAGEYECSAENDVSFPDVRKVKVVVNFAPTIQEIKSGTVTPGRS 250       260       270       280       290       300       310       320
             ....|....|....|....|....|....|....|....|....|....|....|....|....|....|....|....|
CG55920_01   GLIRCEGAGVPPPAFEWYKGEKKLFNGQQGIIIQNFSTRSILTVTNVTQEHFGNYTCVAANKLGTTNASLPLNPPSTAQY
CG55920_04   GLIRCEGAGVPPPAFEWYKGEKKLFNGQQGIIIQNFSTRSILTVTNVTQEHFGNYTCVAANKLGTTNASLPLNPPSTAQY 330       340       350
             ....|....|....|....|....|....
CG55920_01   GITGSADVLFSCWYLVLTLSSFTSIFYLKNAILQ    (SEQ ID NO:24)
CG55920_04   GITGSADVLFSCWYLVLTLSSFTSIFYLKNAILQ    (SEQ ID NO:26)
```

In a search of public sequence databases, NOV12 was found to have homology to the amino acid sequences shown in the BLASTP data listed in Table 12F.

TABLE 12F

BLASTP results for NOV12

| Gene Index/ Identifier | Protein/Organism | Length (aa) | Identity (%) | Positives (%) | Expect |
|---|---|---|---|---|---|
| ptnr:SWISSPROT-ACC:Q9Z0J8 | Kilon protein precursor (Kindred of IgLON) - *Rattus norvegicus* | 348 | 334/352 (94%) | 341/352 (96%) | 1.8e-181 |
| ptnr:SPTREMBL-ACC:Q9W6V2 | NEUROTRACTIN-L - *Gallus gallus* | 352 | 290/351 (82%) | 317/351 (90%) | 5.5e-157 |
| ptnr:SPTREMBL-ACC:Q9W6V1 | NEUROTRACTIN-S - *Gallus gallus* | 261 | 183/226 (80%) | 200/226 (88%) | 1.6e-95 |
| ptnr:SWISSPROT-ACC:Q13449 | Limbic system-associated membrane protein precursor (LSAMP) - *Homo sapiens* | 338 | 186/323 (57%) | 236/323 (73%) | 1.6e-95 |
| ptnr:SWISSPROT-ACC:Q98919 | Limbic system-associated membrane protein precursor (E19S) (CHLAMP, G19-isoform) - *Gallus gallus* | 338 | 182/323 (56%) | 236/323 (73%) | 8.8e-95 |

A multiple sequence alignment is shown in Table 12G, with the protein of the invention being shown on the first line in a ClustalW analysis comparing the protein of the invention with related protein sequences shown in Table 12F.

Table 12G. ClustalW Analysis of NOV12

1) NOV12a CG55920-01 (SEQ ID NO:24)
2) Q9Z0J8 (SEQ ID NO:155)
3) Q9W6V2 (SEQ ID NO:156)
4) Q9W6V1 (SEQ ID NO:157)
5) Q13449 (SEQ ID NO:158)
6) Q98919 (SEQ ID NO:159)

```
                10        20        30        40        50        60        70        80
       ....|....|....|....|....|....|....|....|....|....|....|....|....|....|....|....|
NOV12a MDMMLVQGACCSNQWLAAVLLSLCCLLPSQLPAGQSVDFPWAAVDNMMVRKGDTAVLRCYLEDGASKGAWLNRSSIIFA
Q9Z0J8 --MVLLAQGACCSNQWLAAVLLSLC----SQLPAGQSVDFPWAAVDNMLVRKGDTAVLRCYLEDGASKGAWLNRSSIIFA
Q9W6V2 --MVPLVRGAGGSHQWLAAVLLGLCCLLPAGRLAAPGGDFPGAAADSLVVRKGDTAVLRCYLEDGASKGAWLNRSSIIFA
Q9W6V1 --MVPLVRGAGGSHQWLAAVLLGLCCLLPAGRLAAPGGDFPGAAADSLVVRKGDTAVLRCYLEDGASKGAWLNRSSIIFA
Q13449 --MVGRVQ---PDRKQLPLVLLRLLCLLPTGLPVR-SVDPN-RGTDNLTVRQGDTAILRCVLEDKNSKVAWLNRSGIIFA
Q98919 --MVARAQ---PDRKQLPLVLLRLLCLLPTGLPVR-SVDPT-RGTDNLTVRQGDTAILRCEVEDRSSKVAWLNRSGIIFA 90       100       110       120       130       140       150       160
       ....|....|....|....|....|....|....|....|....|....|....|....|....|....|....|....|
NOV12a GGDKWSVDPRVSISTLNKRDYSLQIQNVDVTDDGPYTCSVQTQHTPRTMQVHLTVQVPPKIYDISNDMTVNEGNNVTLTC
Q9Z0J8 GGDKWSVDPRVSISTLNKREYSLQIQNVDVTDDGPYTCSVQTQHTPRTMQVHLTVQVPPKIYDISNDMINEGNNVTLTC
Q9W6V2 GSDKWSVDPRVSIQTANREYSLQIQDVDVTDDGPYTCSVQTQHTPRTMQVHLTVQVSPKIFRISSDIVVNEGSNVTLVC
Q9W6V1 GSDKWSVDPRVSIATANRREYSLQIQDVDVTDDGPYTCSVQTQHTPRTMQVHLTVQVSPKIFRISSDIVVNEGSNVTLVC
Q13449 GHDKWSLDPRVELEKRHSLEYSLRIQKVDVYDGSYTCSVQTQHEPKTSQVMLIVQVPPKISNISSDVTVNEGSNVTLVC
Q98919 GEDKWSLDPRVELEKRSPLEYSLRIQKVDVYDGSYTCSVQTQHHPKTSQVMLIVQVPPKISNISSDITVNEGSNVTLVC 170       180       190       200       210       220       230       240
       ....|....|....|....|....|....|....|....|....|....|....|....|....|....|....|....|
NOV12a LATGKPEPSISWRHISPSAKPFE-NGQYLDIYGITRDQAGEYECSAENDVSFPDVRKVKVVNEAPTIQEIKSGTVTPGR
Q9Z0J8 LATGKPEPAISWRHISPSAKPFE-NGQYLDIYGITRDQAGEYECSAENDVSFPDVKKVRVVAPTIQEIKSGTVTPGR
Q9W6V2 LATGKPEPSISWRHISPSAKPFE-SGQYLDIYGITRDQAGEYECSAENDVSVPDVKKVKVTVNEAPTIQELKSSGVMLGG
Q9W6V1 LATGKPEPSISWRHISPSAKPFE-SGQYLDIYVITRDQAGEYECSAENDVSVPDVKKVKVTV--------------
Q13449 MANGRPEPVITWRHLTPIGREFEGEEEYLEILGITRECSGKYECKAANEVSSADVKQVKVTVNYPPTITESKSNEATTGR
Q98919 MANGRPEPVITWRHLTPIGKEFEGEEEYLEILGITRQSGKYECKAANEVASADVKQVRVTVNLPPTITESKSNEAATGR 250       260       270       280       290       300       310       320
       ....|....|....|....|....|....|....|....|....|....|....|....|....|....|....|....|
NOV12a SGLIRCEGAGVPPAFEWYKGEKKLFNGQQGIIIQNFSTRSILTVTNVTQEHFGNYTCVAANKLGTTNASLPLNPPSTAQ
Q9Z0J8 SGLIRCEGAGVPPAFEWYKGEKRLFNGQQGIIIQNFSTRSILTVTNVTQEHFGNYTCVAANKLGTTNASLPLNPPSTAQ
Q9W6V2 NGLIRCEGAGVPAFVFEWYKGERKLISGQQGITIKNYSTRSLLTVTNVTBEHFGNYTCVAANKLGMTNASLPLNPPSTAQ
Q9W6V1 ------------------------------------------------------------------NSPSTAQ
Q13449 QASLKCEASAVPAEDFEWYRDDTR-INSANGLEIKSTEGQSLLTVTNVTBEHYGNYTCVAANKLGVTNASLVLFRPGSVR
Q98919 QALLRCEASAVPTEDFEWYRDDTR-INSANGLEIKSTGSQSLLMVANVTBEHYGNYTCVAANKLGVTNASLYLYRPGTGR 330       340       350
       ....|....|....|....|....|....|....|
NOV12a YGITGSADVLFSCWYLVLTLSSPTSIFYLKNAILQ
Q9Z0J8 YGITGSACDLFSCWSLALTLSSVISIFYLKNAILQ
Q9W6V2 YGITGDAEVLFSCWYLVLTLSSLTSIFYLKNIILH
Q9W6V1 YGITGDAEVLFSCWYLVLTLSSLTSIFYLKNIILH
Q13449 -GINGSISIAVPLWLLAASLLCLLSKC--------
Q98919 -VDNGSVSIAVPLWLLAASLLCLLSKC--------
```

Other BLAST results include sequences from the Patp database, which is a proprietary database that contains sequences published in patents and patent publications. Patp results include those listed in Table 12H.

TABLE 12H

Patp BLASTP Analysis for NOV12

| Sequences producing High-scoring Segment Pairs | Protein/Organism | Length (aa) | Identity (%) | Positive (%) | E Value |
|---|---|---|---|---|---|
| patp:AAB31212 | Amino acid sequence of human polypeptide PRO6004 - *Homo sapiens* | 354 | 354/354 (100%) | 354/354 (100%) | 7.2e-194 |
| patp:AAB44331 | Human PRO4993 protein sequence SEQ ID NO:612 - *Homo sapiens* | 352 | 351/352 (99%) | 351/352 (99%) | 7.4e-192 |
| patp:AAW05152 | Human LAMP residues 8–332 - *Homo sapiens* | 325 | 186/323 (57%) | 236/323 (73%) | 1.2e-95 |
| patp:AAW05153 | Rat LAMP residues 1–332 - *Rattus rattus* | 338 | 185/323 (57%) | 235/323 (72%) | 6.8e-95 |
| patp:AAW05154 | Rat LAMP residues 1–332 - *Rattus rattus* | 338 | 185/323 (57%) | 235/323 (72%) | 6.8e-95 |

Table 12I lists the domain description from DOMAIN analysis results against NOV12.

Table 12F. Domain Analysis of NOV12

```
Pfam analysis
    Model    Domain   seq-f   seq-t    hmm-f  hmm-t    score   E-value
    -------  ------   -----   -----    -----  -----    -----   -------
    ig       1/3         53     120 ..      1     45 []  26.5   1.1e-06
    ig       2/3        153     205 ..      1     45 []  28.4   3e-07
    ig       3/3        238     299 ..      1     45 []  27.6   5.4e-07

Alignments of top-scoring domains:
        ig: domain 1 of 3, from 53 to 120: score 26.5, E = 1.1e-06
    (SEQ ID NO:160)            GesvtLtCsvsgfgpp.p.vtWlrngk...................
                                           |+++ |+|+       ++  +  ||  +
++++  +  +++  +  ++
      NOV12a────53──── (SEQ ID NO:366) 53    GDTAVLRCYLE---
DGaSkGAWLNRSSiifaggdkwsvdprvsistl 96

....lslti.svtpeDsgGtYtCvv<-*
                        +++++||+|++|    |+ | ||| |
                     97 nkrdYSLQIqNVDVTDD-GPYTCSV    120 ig: domain 2 of 3, from 153 to 205: score 28.4, E = 3e-07
    (SEQ ID NO:161)            GesvtLtCsvsgfgpp.p.vtWlrngk........lslti.svtpeD
                                   |  |||||  ++   |  |+|+++|++ +++
++ +++  | |  |++             NOV12a    (SEQ ID NO:367) 153    GTNVTLTCLAT--
GKPePsISWRHISPsakpfengQYLDIyGITRDQ 197 sgGtYtCvv<-*
                          +  |+|  |  +
                      198 A-GEYECSA    205 ig: domain 3 of 3, from 238 to 299: score 27.6, E = 5.4e-07
    (SEQ ID NO:162)            GesvtLtCsvsgfgpp.p.vtWlrngk.................lsl
                                      | | ++|+    | |+| + |+++ |+
+++++    ++ ++++  |
          NOV12a  (SEQ ID NO:368) 238    GRSGLIRCEGA--
GVPpPaFEWYKGEKklfngqqgiiiqnfstrSIL 282 ti.svtpeDsgGtYtCvv<-*
```

```
            |+++||+|+   |+|||+
  283   TVtNVTQEHF-GNYTCVA        299
```

In the central nervous system, many cell adhesion molecules are known to participate in the establishment and remodeling of the neural circuit. Some of the cell adhesion molecules are known to be anchored to the membrane by the glycosylphosphatidylinositol (GPI) inserted to their C termini, and many GPI-anchored proteins are known to be localized in a Triton-insoluble membrane fraction of low density or so-called "raft." A novel protein was found in this fraction which was an immunoglobulin superfamily member with three C2 domains and has six putative glycosylation sites. Since this protein shows high sequence similarity to IgLON family members including LAMP, OBCAM, neurotrimin, CEPU-1, AvGP50, and GP55, this protein was termed Kilon (a kindred of IgLON). Kilon immunostaining was observed in the cerebral cortex and hippocampus, in which the strongly stained puncta were observed on dendrites and soma of pyramidal neurons.

The basic structure of immunoglobulin (Ig) molecules is a tetramer of two light chains and two heavy chains linked by disulfide bonds. There are two types of light chains: kappa and lambda, each composed of a constant domain (CL) and a variable domain (VL). There are five types of heavy chains: alpha, delta, epsilon, gamma and mu, all consisting of a variable domain (VH) and three (in alpha, delta and gamma) or four (in epsilon and mu) constant domains (CH1 to CH4). Members of the immunoglobulin superfamily are found in hundreds of proteins of different functions. Examples include antibodies, the giant muscle kinase titin and receptor tyrosine kinases. Immunoglobulin-like domains may be involved in protein—protein and protein-ligand interactions.

NOV13

NOV13 includes two novel Organic Cation Transporter-like proteins disclosed below. The disclosed sequences have been named NOV13a and NOV13b. Unless specifically addressed as NOV13a or NOV13b, any reference to NOV13 is assumed to encompass all variants.

NOV13a

A disclosed NOV13a nucleic acid of 2069 nucleotides (also referred to as CG55988-01) (SEQ ID NO:27) encoding a novel Organic Cation Transporter-like protein is shown in Table 13A. An open reading frame was identified beginning with an ATG initiation codon at nucleotides 279–281 and ending with a TAA codon at nucleotides 1881–1883. Putative untranslated regions upstream from the initiation codon and downstream from the termination codon are underlined and the start and stop codons are in bold in Table 13A.

TABLE 13A

NOV13a nucleotide sequence (SEQ ID NO:27)
GCTTCTAGGCCTTCTCAGTAGATGGAGCTAAGTAATATATGTATATATAC

TAACCCACAGATATAAATATGTCTATAATTATTTCTATATTTATCCATTC

GTGTATATGTTAAGATAAACATGATGGAGACCCTTCAAATTTGCTTATGT

TCTTTTTCAGCCTATAGACCAGATATAATAATTAGCTTTTCTTCTCTTGC

AGATTCCAGAGAGTCCTCTATTTCATATGTGCCTTCCAGAACATCTCTTG

TGGTATTCACTACTTGGCTTCTGTGTTCATGGGAGTCACCCCTCATCATG

TCTGCAGGCCCCCAGGCAATGTGAGTCAGGTTGTTTTCCATAATCACTCT

AATTGGAGTTTGGAGGACACCGGGGCCCTGTTGTCTTCAGGCCAGAAAGA

TABLE 13A-continued

NOV13a nucleotide sequence

TTATGTTACGGTGCAGTTGCAGAATGGTGAGATCTGGGAGCTCTCAAGGT

GTAGCAGGAATAAGAGGGAGAACACATCGAGTTTGGGCTATGAATACACT

GGCAGTAAGAAAGAGTTTCCTTGTGTGGATGGCTACATATATGACCAGAA

CACATGGAAAAGCACTGCGGTGACCCAGTGGAACCTGGTCTGTGACCGAA

AATGGCTTGCAATGCTGATCCAGCCCCTATTTATGTTTGGAGTCCTACTG

GGATCGGTGACTTTTGGCTACTTTTCTGACAGGCTAGGACGCCGGGTGGT

CTTGTGGGCCACAAGCAGTAGCATGTTTTTGTTTGGAATAGCAGCGGCGT

TTGCAGTTGATTATTACACCTTCATGGCTGCTCGCTTTTTTCTTGCCATG

GTTGCAAGTGGCTATCTTGTGGTGGGGTTTGTCTATGTGATGGAATTCAT

TGGCATGAAGTCTCGGACATGGGCGTCTGTCCATTTGCATTCCTTTTTTG

CAGTTGGAACCCTGCTGGTGGCTTTGACAGGATACTTGGTCAGGACCTGG

TGGCTTTACCAGATGATCCTCTCCACAGTGACTGTCCCCTTTATCCTGTG

CTGTTGGGTGCTCCCAGAGACACCTTTTTGGCTTCTCTCAGAGGGACGAT

ATGAAGAAGCACAAAAAATAGTTGACATCATGGCCAAGTGGAACAGGGCA

AGCTCCTGTAAACTGTCAGAACTTTTATCACTGGACCTACAAGGTCCTGT

TAGTAATAGCCCCACTGAAGTTCAGAAGCACAACCTATCATATCTGTTTT

ATAACTGGAGCATTACGAAAAGGACACTTACCGTTTGGCTAATCTGGTTC

ACTGGAAGTTTGGGATTCTACTCGTTTTCCTTGAATTCTGTTAACTTAGG

AGGCAATGAATACTTAAACCTCTTCCTCCTGGGTGTAGTGGAAATTCCCG

CCTACACCTTCGTGTGCATCGCCATGGACAAGGTCGGGAGGAGAACAGTC

CTGGCCTACTCTCTTTTCTGCAGTGCACTGGCCTGTGGTGTCGTTATGGT

GATCCCCAGAAACATTATATTTTGGGTGTGGTGACAGCTATGGTTGGAA

AATTTGCCATCGGGGCAGCATTTGGCCTCATTTATCTTTATACAGCTGAG

CTGTATCCAACCATTGTAAGATCGCTGGCTGTGGGAAGCGGCAGCATGGT

GTGTCGCCTGGCCAGCATCCTGGCGCCGTTCTCTGTGGACCTCAGCAGCA

TTTGGATCTTCATACCACAGTTGTTTGTTGGGACTATGGCCCTCCTGAGT

GGAGTGTTAACACTAAAGCTTCCAGAAACCCTTGGGAAACGGCTAGCAAC

TACTTGGGAGGAGGCTGCAAAACTGGAGTCAGAGAATGAAAGCAAGTCAA

GCAAATTACTTCTCACAACTAATAATAGTGGGCTGGAAAAAACGGAAGCG

ATTACCCCCAGGGATTCTGGTCTTGGTGAATAAATGTGCCATGCCTGCTG

TCTAGCACCTGAAATATTATTTACCCTAATGCCTTTGTATTAGAGGAATC

TTATTCTCATCTCCCATATGTTGTTTGTATGTCTTTTTAATAAATTTTGT

AAGAAAATTTTAAAGCAAATATGTTATAAAAGAAATAAAAACTAAGATGA

AAATTCTCAGTTTTAAAAA

The Organic Cation Transporter-like NOV13a disclosed in this invention maps to chromosome 6.

In a search of sequence databases, it was found, for example, that the nucleic acid sequence of this invention has 411 of 682 bases (60%) identical to a gb:GENBANK-ID: AB015050|acc:AB015050.1 mRNA from *Homo sapiens* (*Homo sapiens* mRNA for OCTN2, complete cds).

A disclosed NOV13a polypeptide (SEQ ID NO:28) encoded by SEQ ID NO:27 has 534 amino acid residues is presented in Table 13B using the one-letter code. NOV13a is likely a Type IIIa membrane protein (Ncyt Cexo) with an INTEGRAL Likelihood of −5.89 for Transmembrane 229–245 (228–246), an INTEGRAL Likelihood of −5.10 for Transmembrane 376–392 (373–395), an INTEGRAL Likelihood of −4.57 for Transmembrane 171–187 (165–191), an INTEGRAL Likelihood of −4.51 for Transmembrane 348–364 (346–366), an INTEGRAL Likelihood of −3.08 for Transmembrane 205–221 (205–222), an INTEGRAL Likelihood of −3.03 for Transmembrane 111–127 (108–129), an INTEGRAL Likelihood of −2.44 for Transmembrane 398–414 (397–415), an INTEGRAL Likelihood of −2.07 for Transmembrane 465–481 (465–481), an INTEGRAL Likelihood of −1.12 for Transmembrane 140–156 (140–156), and an INTEGRAL Likelihood of −0.59 for Transmembrane 446–462 (446–463). The Psort and Hydropathy results predict that NOV13a has a signal peptide and is likely to be localized to the plasma membrane with a certainty of 0.6000. In an alternative embodiment, NOV13a is likely to be localized to the Golgi body with a certainty of 0.4000, or to the endoplasmic reticulum (membrane) with a certainty of 0.3000, or to the microbody (peroxisome) with a certainty of 0.3000.

TABLE 13B

NOV13a protein sequence (SEQ ID NO:28)
MGVTPHHVCRPPGNVSQVVFHNNSNWSLEDTGALLSSGQKDYVTVQLQNG

EIWELSRCSRNKRENTSSLGYEYTGSKKEFPCVDGYIYDQNTWKSTAVTQ

WNLVCDRKWLAMLIQPLFMFGVLLGSVTFGYFSDRLGRRVVLWATSSSMF

LFGIAAAFAVDYYTFMAARFFLAMVASGYLVVGFVYVMEFIGMKSRTWAS

VHLHSFFAVGTLLVALTGYLVRTWWLYQMILSTVTVPFILCCWVLPETPF

WLLSEGRYEEAQKIVDIMAKWNRASSCKLSELLSLDLQGPVSNSPTEVQK

HNLSYLFYNWSITKRTLTVWLIWFTGSLGFYSFSLNSVNLGGNEYLNLFL

LGVVEIPAYTFVCIAMDKVGRRTVLAYSLFCSALACGVVMVIPQKHYILG

VVTAMVGKFAIGAAFGLIYLYTAELYPTIVRSLAVGSGSMVCRLASILAP

FSVDLSSIWIFIPQLFVGTMALLSGVLTLKLPETLGKRLATTWEEAAKLE

SENESKSSKLLLTTNNSGLEKTEAITPRDSGLGE

The full amino acid sequence of the protein of the invention was found to have 430 of 430 amino acid residues (100%) identical to, and 430 of 430 amino acid residues (100%) similar to, the 456 amino acid residue ptnr:SP-TREMBL-ACC:O14567 protein from Homo sapiens (Human) (WUGSC:RG331P03.1 PROTEIN).

The Organic Cation Transporter disclosed in this invention is expressed in at least the following tissues: Liver, Spleen, germ cell, heart, lung, testis, b-cell. The nucleic acids and proteins of the invention are useful in potential diagnostic and therapeutic applications implicated in various diseases and disorders described below and/or other pathologies. For example, the compositions of the present invention will have efficacy for treatment of patients suffering from: Cardiomyopathy, Atherosclerosis, Hypertension, Congenital heart defects, Aortic stenosis, Atrial septal defect (ASD), Atrioventricular (A-V) canal defect, Ductus arteriosus, Pulmonary stenosis, Subaortic stenosis, Ventricular septal defect (VSD), valve diseases, Tuberous sclerosis, Scleroderma, Obesity, Transplantation, Von Hippel-Lindau (VHL) syndrome, Cirrhosis, Hemophilia, Hypercoagulation, Idiopathic thrombocytopenic purpura, Immunodeficiencies, Graft versus host, Fertility, Systemic lupus erythematosus, Autoimmune disease, Asthma, Emphysema, Scleroderma, allergy, ARDS, and other diseases, disorders and conditions of the like.

NOV13b

A disclosed NOV13b nucleic acid of 1666 nucleotides (also referred to as CG55988-02) (SEQ ID NO:29) encoding a novel Organic Cation Transporter-like protein is shown in Table 13C. An open reading frame was identified beginning with an ATG initiation codon at nucleotides 76–78 and ending with a TAA codon at nucleotides 1654–1656. Putative untranslated regions upstream from the initiation codon and downstream from the termination codon are underlined and the start and stop codons are in bold in Table 13C.

TABLE 13C

NOV13b nucleotide sequence (SEQ ID NO:29)
TTCCAGAGAGTCCTCTATTTCATATGTGCCTTCCAGAACATCTCTTGTGG

TATTCACTACTTGGCTTCTGTGTTCATGGGAGTCACCCCTCATCATGTCT

GCAGGCCCCCAGGCAATGTGAGTCAGGTTGTTTTCCATAATCACTCTAAT

TGGAGTTTGGAGGACACCGGGGCCCTGTTGTCTTCAGGCCAGAAAGATTA

TGTTACGGTGCAGTTGCAGAATGGTGAGATCTGGGAGCTCTCAAGGTGTA

GCAGGAATAAGAGGGAGAACACATCGAGTTTGGGCTATGAATACACTGGC

AGTAAGAAAGAGTTTCCTTGTGTGGATGGCTACATATATGACCAGAACAC

ATGGAAAAGCACTGCGGTGACCCAGTGGAACCTGGTCTGTGACCGAAAAT

GGCTTGCAATGCTGATCCAGCCCCTATTTATGTTTGGAGTCCTACTGGGA

TCGGTGACTTTTGGCTACTTTTCTGACAGGCTTTTTTGCCTATATGTGAT

TTGCAATGGGGTCAGACTCCTCAATAGTTATAAATGTGACCTTGAATATA

AATCCCTATTATTTGTTTTTCAGGTTGCAAGTGGCTATCTTGTGGTGGGG

TTTGTCTATGTGATGGAATTCATTGGCATGAAGTCTCGGACATGGGCGTC

TGTCCATTTGCATTCCTTTTTTGCAGTTGGAACCCTGCTGGTGGCTTTGA

CAGGATACTTGGTCAGGACCTGGTGGCTTTACCAGATGATCCTCTCCACA

GTGACTGTCCCCTTTATCCTGTGCTGTTGGGTGCTCCCAGAGACACCTTT

TTGGCTTCTCTCAGAGGGACGATATGAAGAAGCACAAAAAATAGTTGACA

TCATGGCCAAGTGGAACAGGGCAAGCTCCTGTAAACTGTCAGAACTTTTA

TCACTGGACCTACAAGGTCCTGTTAGTAATAGCCCCACTGAAGTTCAGAA

GCACAACCTATCATATCTGTTTTATAACTGGAGCATTACGAAAAGGACAC

TTACCGTTTGGCTAATCTGGTTCACTGGAAGTTTGGGATTCTACTCGTTT

TCCTTGAATTCTGTTAACTTAGGAGGCAATGAATACTTAAACCTCTTCCT

CACAGGTGTAGTGGAAATTCCCGCCTACACCTTCGTGTGCATCGCCATGG

ACAAGGTCGGGAGGAGAACAGTCCTGGCCTACTCTCTTTTCTGCAGTGCA

CTGGCCTGTGGTGTCGTTATGGTGATCCCCCAGGTGAGTTATCTTCTGGG

TGTGGTGACAGCTATGGTTGGAAAATTTGCCATCGGGGCAGCATTTGGCC

TABLE 13C-continued

NOV13b nucleotide sequence

TCATTTATCTTTATACAGCTGAGCTGTATCCAACCATTGTAAGGTCGCTG

GCTGTGGGAAGCGGCAGCATGGTGTGTCGCCTGGCCAGCATCCTGGCGCC

GTTCTCTGTGGACCTCAGCAGCATTTGGATCTTCATACCACAGTTGTTTG

TTGGGACTATGGCCCTCCTGAGTGGAGTGTTAACACTAAAGCTTCCAGAA

ACCCTTGGGAAACGGCTAGCAACTACTTGGGAGGAGGCTGCAAAACTGGA

GTCAGAGAATGAAAGCAAGTCAAGCAAATTACTTCTCACAACTAATAATA

GTGGGCTGGAAAAAACGGAAGCGATTACCCCCAGGGATTCTGGTCTTGGT

GAATAAATGTGCCATG

The Organic Cation Transporter-like NOV13b disclosed in this invention maps to chromosome 6.

In a search of sequence databases, it was found, for example, that the nucleic acid sequence of this invention has 407 of 682 bases (59%) identical to a gb:GENBANK-ID: AB015050|acc:AB015050.1 mRNA from *Homo sapiens* (*Homo sapiens* mRNA for OCTN2, complete cds).

A disclosed NOV13b polypeptide (SEQ ID NO:30) encoded by SEQ ID NO:29 has 526 amino acid residues is presented in Table 13D using the one-letter code. NOV13b is likely a Type IIIa membrane protein (Ncyt Cexo) with an INTEGRAL Likelihood of −5.89 for Transmembrane 221–237 (220–238), an INTEGRAL Likelihood of −5.10 for Transmembrane 368–384 (365–399), an INTEGRAL Likelihood of −4.94 for Transmembrane 161–177 (160–180), an INTEGRAL Likelihood of −3.08 for Transmembrane 197–213 (197–214), an INTEGRAL Likelihood of −3.03 for Transmembrane 111–127 (108–129), an INTEGRAL Likelihood of −2.13 for Transmembrane 340–356 (340–358), an INTEGRAL Likelihood of −2.07 for Transmembrane 390–406 (389–407), an INTEGRAL Likelihood of −2.07 for Transmembrane 457–473 (457–473), and an INTEGRAL Likelihood of −0.59 for Transmembrane 438–454 (438–455).

NOV13b PSORT results suggest that the organic cation transporter-like protein may be localized at the plasma membrane via a glycosyl phosphtidylinositol anchor typical of type III proteins. However, the protein of CuraGen Acc. No. CG55988-02 predicted here is similar to the transporter family, all members of which are localized to the plasma membrane with membrane-spanning segments. This prediction is also consistent with the results of the hydrophobicity analysis. Therefore it is likely that this novel organic cation transporter-like protein is localized to the plasma membrane with a certainty of 0.6000. In an alternative embodiment, NOV13a is likely to be localized to the Golgi body with a certainty of 0.4000, or to the endoplasmic reticulum (membrane) with a certainty of 0.3000, or to the microbody (peroxisome) with a certainty of 0.3000.

TABLE 13D

NOV13b protein sequence (SEQ ID NO:30)
MGVTPHHVCRPPGNVSQVVFNNHSNWSLEDTGALLSSGQKDYVTVQLQNG

EIWELSRCSRNKRENTSSLGYEYTGSKKEFPCVDGYIYDQNTWKSTAVTQ

TABLE 13D-continued

NOV13b protein sequence

WNLVCDRKWLAMLIQPLFMFGVLLGSVTFGYFSDRLFCLYVICNGVRLLN

SYKCDLEYKSLLFVFQVASGYLVVGFVYVMEFIGMKSRTWASVHLHSFFA

VGTLLVALTGYLVRTWWLYQMILSTVTVPFILCCWVLPETPFWLLSEGRY

EEAQKIVDIMAKWNRASSCKLSELLSLDLQGPVSNSPTEVQKHNLSYLFY

NWSITKRTLTVWLIWFTGSLGFYSFSLNSVNLGGNEYLNLFLTGVVEIPA

YTFVCIAMDKVGRRTVLAYSLFCSALACGVVMVIPQVSYLLGVVTAMVGK

FAIGAAFGLIYLYTAELYPTIVRSLAVGSGSMVCRLASILAPFSVDLSSI

WIFIPQLFVGTMALLSGVLTLKLPETLGKRLATTWEEAAKLESENESKSS

KLLLTTNNSGLEKTEAITPRDSGLGE

The full amino acid sequence of the protein of the invention was found to have 168 of 490 amino acid residues (34%) identical to, and 270 of 490 amino acid residues (55%) similar to, the 551 amino acid residue ptnr:SP-TREMBL-ACC:O14546 protein from *Homo sapiens* (Human) (POLYSPECIFIC ORGANIC CATION TRANSPORTER).

The organic cation transporter-like gene disclosed in this invention is expressed in at least the following tissues: bone marrow, lymphoid tissue, testis, pituitary gland, pancreas, brain, liver and spleen. It is also expressed in the following disease conditions: anaplastic astrocytoma, colorectal carcinoma, ovarian serous adenocarcinoma, ovarian cystadenoma, fibrillary astrocytoma, oligodendroglioma, pilocytic astrocytoma, breast cancer. It is upregulated in microvascular endothelial cells in response to vascular endothelial growth factor treatment. Furthermore, the sequence is predicted to be expressed in the following tissues because of the expression pattern of (GENBANK-ID: gb:GENBANK-ID: AB015050|acc:AB015050.1) a closely related *Homo sapiens* mRNA for OCTN2, complete cds homolog in species *Homo sapiens*: kidney, skeletal muscle, heart, and placenta.

The nucleic acids and proteins of the invention have applications in the diagnosis and/or treatment of various diseases and disorders. For example, the compositions of the present invention will have efficacy for the treatment of patients suffering from: hemophilia, hypercoagulation, idiopathic thrombocytopenic purpura, autoimmune disease, allergies, immunodeficiencies, transplantation, graft versus host disease (GVHD), lymphaedema, fertility disorders, endocrine dysfunctions, diabetes, obesity, growth and reproductive disorders, Von Hippel-Lindau (VHL) syndrome, Alzheimer's disease, stroke, tuberous sclerosis, hypercalcemia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, pancreatitis, cirrhosis, cancer, tissue degeneration, bacterial/viral/parasitic infections as well as other diseases, disorders and conditions.

NOV13a and NOV13b share a high degree of homology as is shown in the amino acid alignment in Table 13E.

Table 13E. Clustal W Alignment of NOV13a and NOV13b

```
                        10        20        30        40        50        60        70        80
                 ....|....|....|....|....|....|....|....|....|....|....|....|....|....|....|....|
CG55988_01       MGVTPHHVCRPPGNVSQVVFHNHSNWSLEDTGALLSSGQKDYVTVQLQNGEIWELSRCSRNKRENTSSLGYEYTGSKKEF
CG55988_02       MGVTPHHVCRPPGNVSQVVFHNHSNWSLEDTGALLSSGQKDYVTVQLQNGEIWELSRCSRNKRENTSSLGYEYTGSKKEF 90       100       110       120       130       140       150       160
                 ....|....|....|....|....|....|....|....|....|....|....|....|....|....|....|....|
CG55988_01       PCVDGYIYDQNTWKSTAVTQWNLVCDRKWLAMLIQPLFMFGVLLGSVTFGYFSDRLGRRVVLWATSSSMFLFGIAAAFAV
CG55988_02       PCVDGYIYDQNTWKSTAVTQWNLVCDRKWLAMLIQPLFMFGVLLGSVTFGYFSDRL---FCLYVICNGVRLLN-SYKCDL 170       180       190       200       210       220       230       240
                 ....|....|....|....|....|....|....|....|....|....|....|....|....|....|....|....|
CG55988_01       DYYFMAARFFLAMVASGYLVVGFVYVMEFIGMKSRTWASVHLHSFFAVGTLLVALTGYLVRTWWLYQMILSTVTVPFIL
CG55988_02       EYKSLL----FVFQVASGYLVVGFVYVMEFIGMKSRTWASVHLHSFFAVGTLLVALTGYLVRTWWLYQMILSTVTVPFIL 250       260       270       280       290       300       310       320
                 ....|....|....|....|....|....|....|....|....|....|....|....|....|....|....|....|
CG55988_01       CCWVLPETPFWLLSEGRYEEAQKIVDIMAKWNRASSCKLSELLSLDLQGPVSNSPTEVQKHNLSYLFYNWSITKRTLTVW
CG55988_02       CCWVLPETPFWLLSEGRYEEAQKIVDIMAKWNRASSCKLSELLSLDLQGPVSNSPTEVQKHNLSYLFYNWSITKRTLTVW 330       340       350       360       370       380       390       400
                 ....|....|....|....|....|....|....|....|....|....|....|....|....|....|....|....|
CG55988_01       LIWFTGSLGFYSFSLNSVNLGGNEYLNLFLLGVVEIPAYTFVCIAMDKVGRRTVLAYSLFCSALACGVVMVIPQKHYILG
CG55988_02       LIWFTGSLGFYSFSLNSVNLGGNEYLNLFLTGVVEIPAYTFVCIAMDKVGRRTVLAYSLFCSALACGVVMVIPQVSYLLG 410       420       430       440       450       460       470       480
                 ....|....|....|....|....|....|....|....|....|....|....|....|....|....|....|....|
CG55988_01       VVTAMVGKFAIGAAFGLIYLYTAELYPTIVRSLAVGSGSMVCRLASILAPFSVDLSSIWIFIPQLFVGTMALLSGVLTLK
CG55988_02       VVTAMVGKFAIGAAFGLIYLYTAELYPTIVRSLAVGSGSMVCRLASILAPFSVDLSSIWIFIPQLFVGTMALLSGVLTLK 490       500       510       520       530
                 ....|....|....|....|....|....|....|....|....
CG55988_01       LPETLGKRLATTWEEAAKLESENESKSSKLLLTTNNSGLEKTEAITPRDSGLGE    (SEQ ID NO:28)
CG55988_02       LPETLGKRLATTWEEAAKLESENESKSSKLLLTTNNSGLEKTEAITPRDSGLGE    (SEQ ID NO:30)
```

In a search of public sequence databases, NOV13 was found to have homology to the amino acid sequences shown in the BLASTP data listed in Table 13F.

TABLE 13F

BLASTP results for NOV13

| Gene Index/ Identifier | Protein/Organism | Length (aa) | Identity (%) | Positives (%) | Expect |
|---|---|---|---|---|---|
| ptnr:SPTREMBL-ACC:Q96RU0 | ORGANIC CATION TRANSPORTER OKB1 - *Homo sapiens* | 577 | 533/534 (99%) | 533/534 (99%) | 7.2e-290 |
| ptnr:SPTREMBL-ACC:O14567 | WUGSC:RG331P03.1 PROTEIN - *Homo sapiens* | 456 | 430/430 (100%) | 430/430 (100%) | 1.8e-236 |
| ptnr:SPTREMBL-ACC:Q96M90 | CDNA FLJ32744 FIS, CLONE TESTI2001420, WEAKLY SIMILAR TO *D. MELANOGASTER* PUTATIVE ORGANIC CATION TRANSPORTER - *Homo sapiens* | 361 | 353/354 (99%) | 353/354 (99%) | 2.4e-188 |
| ptnr:SPTREMBL-ACC:Q9UJ10 | DJ261K5.1 (NOVEL ORGANIC CATION TRANSPORTER (BAC ORF RG331P03)) - *Homo sapiens* | 305 | 305/305 (100%) | 305/305 (100%) | 2.9e-160 |
| ptnr:SPTREMBL-ACC:Q9D5Z0 | 4921504E14RIK PROTEIN - *Mus musculus* | 419 | 166/317 (52%) | 219/317 (69%) | 3.3e-88 |

A multiple sequence alignment is shown in Table 13G, with the protein of the invention being shown on the first line in a ClustalW analysis comparing the protein of the invention with related protein sequences shown in Table 13F.

Table 13G. ClustalW Analysis of NOV13

1) NOV13a CG55988-01 (SEQ ID NO:28)
2) Q96RU0 (SEQ ID NO:163)
3) O14567 (SEQ ID NO:164)
4) Q96M90 (SEQ ID NO:165)
5) Q9UJ10 (SEQ ID NO:166)
6) Q9D5Z0 (SEQ ID NO:167)

```
                   10        20        30        40        50        60        70        80
           ....|....|....|....|....|....|....|....|....|....|....|....|....|....|....|....|
NOV13a     ----------------------------------------MGVTPHHVCRPPGNVSQVVFHNHSNWSLEDTGALLSS
Q96RU0     MGSRHFEGIYDHVGHFGRFQRVLYFICAFQNISCGIHYLASVFMGVTPHHVCRPPGNVSQVVFHNHSNWSLEDTGALLSS
O14567     ----------------RFQRVLYFICAFQNISCGIHYLASVFMGVTPHHVCRPPGNVSQVVFHNHSNWSLEDTGALLSS
Q96M90     --------------------------------------------------------------------------------
Q9UJ10     --------------------------------------------------------------------------------
Q9D5Z0     --------------------------------------------------------------------------------

90       100       110       120       130       140       150       160
           ....|....|....|....|....|....|....|....|....|....|....|....|....|....|....|....|
NOV13a     GQKDYVTVQLQNGEIWELSRCSRNKRENTSSLGYEYTGSKKEFPCVDGYIYDQNTWKSTAVTQWNLVCDRKWLAMLIQPL
Q96RU0     GQKDYVTVQLQNGEIWELSRCSRNKRENTSSLGYEYTGSKKEFPCVDGYIYDQNTWKSTAVTQWNLVCDRKWLAMLIQPL
O14567     GQKDYVTVQLQNGEIWELSRCSRNKRENTSSLGYEYTGSKKEFPCVDGYIYDQNTWKSTAVTQWNLVCDRKWLAMLIQPL
Q96M90     ----------------------------------------------------------------------MLIQPL
Q9UJ10     --------------------------------------------------------------------------------
Q9D5Z0     --------------------------------------------------------------------------------

170       180       190       200       210       220       230       240
```

```
             ....|....|....|....|....|....|....|....|....|....|....|....|....|....|....|....|
NOV13a       FMFGVLLGSVTFGYFSDRLGRRVVLWATSSSMFLFGIAAAFAVDYYTFMAARFFLAMVASGYLVVGFVYVMEFIGMKSRT
Q96RU0       FMFGVLLGSVTFGYFSDRLGRRVVLWATSSSMFLFGIAAAFAVDYYTFMAARFFLAMVASGYLVVGFVYVMEFIGMKSRT
O14567       FMFGVLLGSVTFGYFSDRLGRRVVLWATSSSMFLFGIAAAFAVDYYTFMAARFFLAMVASGYLVVGFVYVMEFIGMKSRT
Q96M90       FMFGVLLGSVTFGYFSDRLGRRVVLWATSSSMFLFGIAAAFAVDYYTFMAARFFLAMVASGYLVVGFVYVMEFIGMKSRT
Q9UJ10       --------------------------------------------------------------------------------
Q9D5Z0       ----------------------------------------------------------------------MEMTGKKART 250       260       270       280       290       300       310       320
             ....|....|....|....|....|....|....|....|....|....|....|....|....|....|....|....|
NOV13a       WASVHLHSFFAVGTLLVALTGYLVRTWWLYQMILSTVTVPFILCCWVLPETPFWLLSEGRYEEAQKIVDIMAKWNRASSC
Q96RU0       WASVHLHSFFAVGTLLVALTGYLVRTWWLYQMILSTVTVPFILCCWVLPETPFWLLSEGRYEEAQKIVDIMAKWNRASSC
O14567       WASVHLHSFFAVGTLLVALTGYLVRTWWLYQMILSTVTVPFILCCWVLPETPFWLLSEGRYEEAQKIVDIMAKWNRASSC
Q96M90       WASVHLHSFFAVGTLLVALTGYLVRTWWLYQMILSTVTVPFILCCWVLPETPFWLLSEGRYEEAQKIVDIMAKWNRASSC
Q9UJ10       ---------------------------------ILSTVTVPFILCCWVLPETPFWLLSEGRYEEAQKIVDIMAKWNRASSC
Q9D5Z0       WASIHLNIFFAIGAMLVALASYLLKTWWLYQIILCIVTTPFILCCWMLPETPFWLLSEGRYKEACGTVDIMAVWNKSSSC 330       340       350       360       370       380       390       400
             ....|....|....|....|....|....|....|....|....|....|....|....|....|....|....|....|
NOV13a       KLSELLSLDLQGPVSNSPTEVQKHNLSYLFYNWSITKRTLTVWLIWFTGSLGFYSFSLNSVNLGGNEYLNLFLLGVVEIP
Q96RU0       KLSELLSLDLQGPVSNSPTEVQKHNLSYLFYNWSITKRTLTVWLIWFTGSLGFYSFSLNSVNLGGNEYLNLFLLGVVEIP
O14567       KLSELLSLDLQGPVSNSPTEVQKHNLSYLFYNWSITKRTLTVWLIWFTGSLGFYSFSLNSVNLGGNEYLNLFLLGVVEIP
Q96M90       KLSELLSLDLQGPVSNSPTEVQKHNLSYLFYNWSITKRTLTVWLIWFTGSLGFYSFSLNSVNLGGNEYLNLFLLGVVEIP
Q9UJ10       KLSELLSLDLQGPVSNSPTEVQKHNLSYLFYNWSITKRTLTVWLIWFTGSLGFYSFSLNSVNLGGNEYLNLFLLGVVEIP
Q9D5Z0       DLVELLSLDVTRSHNKSPHSIRKHRLADLFFNLDVAKMTLIVWLDWFTANLGYYMFGKEVIRRKENEPLYLLLVGAMEIP 410       420       430       440       450       460       470       480
             ....|....|....|....|....|....|....|....|....|....|....|....|....|....|....|....|
NOV13a       AYTFVCIAMDKVGRRTVLAYSLFCSALACGVVMVIPQKHYILGVVTAMVGKFAIGAAFGLIYLYTAELYPTIVRSLAVGS
Q96RU0       AYTFVCIAIDKVGRRTVLAYSLFCSALACGVVMVIPQKHYILGVVTAMVGKFAIGAAFGLIYLYTAELYPTIVRSLAVGS
O14567       AYTFVCIAIDKVGRRTVLAYSLFCSALACGVVMVIPQKHYILGVVTAMVGKFAIGAAFGLIYLYTAELYPTIV-------
Q96M90       AYTFVCIAIDKVGRRTVLAYSLFCSALACGVVMVIPQKHYILGVVTAMVGKFAIGAAFGLIYLYTAELYPTIVRSLAVGS
Q9UJ10       AYTFVCIAIDKVGRRTVLAYSLFCSALACGVVMVIPQKHYILGVVTAMVGKFAIGAAFGLIYLYTAELYPTIVRSLAVGS
Q9D5Z0       AYICLCIWLKRVGRRKTMLLFLLVSSLTQMLHVVMFSDYKTAKRMVALLVKSVISSVFAFIYLYTAELYPTIVRCLAVGS 490       500       510       520       530       540       550       560
             ....|....|....|....|....|....|....|....|....|....|....|....|....|....|....|....|
NOV13a       GSMVCRLASILAPFSVDLSSIWIFIPQLFVGTMALLSGVLLLKLPETLGKRLATTWEEAAKLESENESKSSKLLLTTNNS
Q96RU0       GSMVCRLASILAPFSVDLSSIWIFIPQLFVGTMALLSGVLLLKLPETLGKRLATTWEEAAKLESENESKSSKLLLTTNNS
O14567       --------------------------------------------------------------------------------
Q96M90       GSMVCRLASILAPFSVDLSSIWIFIPQLLGQHIQE---------------------------------------------
Q9UJ10       GSMVCRLASILAPFSVDLSSIWIFIPQLFVGTMALLSGVLLLKLPETLGKRLATTWEEAAKLESENESKSSKLLLTTNNS
Q9D5Z0       SNMVSHVSSIFIPFTSHFSKVWIFLPQLFGILAILSGLLSLKLPETQDTPMKSTWEITEQQVPENKDSLGEGPPDSFER 570       580       590       600       610       620       630       640
             ....|....|....|....|....|....|....|....|....|....|....|....|....|....|....|....|
NOV13a       GLEKTEAITPRDSGLGE---------------------------------------------------------------
Q96RU0       GLEKTEAITPRDSGLGE---------------------------------------------------------------
O14567       --------------------------------------------------------------------------------
Q96M90       --------------------------------------------------------------------------------
Q9UJ10       GLEKTEAITPRDSGLGE---------------------------------------------------------------
Q9D5Z0       WDSSRALSFAERWGLSRASPDAEKWGSGRVPPDAGKWGAGIAPPVTERGASGRASLEDESGGSGRAPPEKNTEMENEIEN

....|....
NOV13a       ---------
Q96RU0       ---------
O14567       ---------
Q96M90       ---------
Q9UJ10       ---------
Q9D5Z0       MKVSNLGGF
```

Other BLAST results include sequences from the Patp database, which is a proprietary database that contains sequences published in patents and patent publications. Patp results include those listed in Table 13H.

TABLE 13H

Patp BLASTP Analysis for NOV13

| Sequences producing High-scoring Segment Pairs | Protein/Organism | Length (aa) | Identity (%) | Positive (%) | E Value |
|---|---|---|---|---|---|
| patp:AAB43038 | Human ORFX ORF2802 polypeptide sequence SEQ ID NO:5604 - *Homo sapiens* | 560 | 534/534 (100%) | 534/534 (100%) | 1.3e-290 |
| patp:AAM78367 | Human protein SEQ ID NO 1029 - *Homo sapiens* | 577 | 534/534 (100%) | 534/534 (100%) | 1.3e-290 |
| patp:AAM00930 | Human bone marrow protein, SEQ ID NO: 406 - *Homo sapiens* | 584 | 532/535 (99%) | 532/535 (99%) | 1.7e-288 |
| patp:AAM79351 | Human protein SEQ ID NO 2997 - *Homo sapiens* | 585 | 528/536 (98%) | 528/536 (98%) | 4.2e-285 |
| patp:AAM00982 | Human bone marrow protein, SEQ ID NO: 483 - *Homo sapiens* | 483 | 399/400 (99%) | 400/400 (100%) | 4.2e-219 |

Table 13I lists the domain description from DOMAIN analysis results against NOV13.

Table 13I. Domain Analysis of NOV13

```
Pfam analysis

Model    Domain  seq-f  seq-t     hmm-f hmm-t    score    E-value
    -------- ------- ------ -----     ----- -----    -----    -------
    ABC-3    1/1     115    312   ..  1     267  []  -189.9   4.6
    Abi      1/1     348    442   ..  1     119  []   -20.1   1.9
    sugar_tr 1/1      77    495   ..  1     488  []    48.5   1.5e-10

Alignments of top-scoring domains:
       ABC-3: domain 1 of 1, from 115 to 312: score -189.9, E = 4.6
     (SEQ ID NO:168)           qyefmqrAllasilvglacgiLGsFlVLRRqSLmGDAiSHavLpGVA
                                  ||+ +||+|+   | ++  ||          ||
+|   +++|     | |+|
      NOV13a     (SEQ ID NO:369) 115    QPLFMFGVLLGSVTFGYFSDRLG-----RRVVLW-
ATSSSMFLFGIA 155

LAffLginkSleipliGAflfglia....AvaigylkrnsrlkeDtaiGI
                       ||+ +      + ++ |+ +++|++   +|+++|+++      |+ |    +
                   156 AAFAVDYYT----FMAARFFLAMVAsgylVVGFVYVMEFIGMKSRTWASV 201 vfssflAlGlllislikgsnaaskvdLdhyLFGniLgisqqDliqiaiit
                       ++||+|+|  ||+ |+          ||   + +  + ++|++ +++
                   202 HLHSFFAVGTLLVALTG-----------YL---VRTWWLYQMILSTVTV 236 aiiLlllllfwkeLllitFDpdlAkviGlpvnflkllLliLlaltiVval
                       +||+  +|    ++ |++        +|
                   237 PFILCCWVLPETPFWLLS--------EG---------------------- 256 qaVGvILViAlLitPAatArlltkslesmlliAsaiGvvssvaGlllSYy
                       ++ +  + + +  |         ++|+ +   |||
                   257 --------------------RYEEAQKIVDIMAKWNRASSCKLSELLSLD 286 fd..tatGpvIVLiatllFlisflfa<-*
                       + ++++ +|+  |   | +|+  + +
                   287 LQgpVSNSPTEVQKHNLSYLFYNWSI    312

Abi: domain 1 of 1, from 348 to 442: score -20.1, E = 1.9
     (SEQ ID NO:169)
llilllvllaplaEElfFRGilltalerr.lkkrytlfgpllaiiis
                                                |++| +| + +       | +| +
```

```
          +||+        ++ + +++++
     NOV13a    (SEQ ID NO:370) 348      LFLLGVVEIPA----YTFVCIAMDKVGRRtVLA----
YSLFCSALAC 386 sliFallHlanalellqllgnvliqpvlinwlqllytfllGlvlgllylr
                     +++  +  +++|+             ++ +++ |++| +||+||
                 387 GVVMVIPQKHYILG---------------VVTAMVGKFAIGAAFGLIYL- 420 rtgsLlapilvHalnNligfill<-*
                     +|  |  +| +| +  | +++
                 421 YTAELYP-TIVRSLAVGSGSMVC     442 sugar_tr: domain 1 of 1, from 77 to 495: score 48.5, E = 1.5e-10
        (SEQ ID NO:170)         valvaalgGgflfGyDtgviggflalidflfrfglltssgalaelvg
                                  +  + ++  |  + ||  +  +++   +
+ +++ ++
     NOV13a    (SEQ ID NO:371) 77       KKEFPCVDG---YIYDQNTWKSTAVTQW----
NLVCDRKWLAM---- 112 ystvltglvvsifflGrliGslfaGklgdrfGRkksllialvlfviGall
                      |+    |++|  |+||+ +|+++||+||+   | +++  ++  ++
                 113 -------LIQPLFMFGVLLGSVTFGYFSDRLGRRVVLWATSSSMFLFGIA 155 sgaapgytTiGlwafyllivGRvlvGlgvGgasvlvPmYisEiAPkalRG
                     ++|         ++|  ++++|+++ + +   |+ +|+ |+   + |
                 156 AAFAV-------DYYTFMAARFFLAMVASGYLVVGFVYVMEFIGMKSRT  197 algslyqlaitiGilvAaiiglgl.nktnndsalnswgWRiplglqlvpa
                     +   ++ ++|  |+ |++|+ ++  +                + + +
                 198 WASVHLHSFFAVGTLLVALTGYLVrTWWLY-----------QMILSTVT  235 lllliglllflPESPRwLvekgkleeArevLaklrgvedvdqeiqeikael
                     +++++++++ |||+|+||++ |++||||++++     ++ ++ +  + +|
                 236 VPFILCCWVLPETPFWLLSEGRYEEAQKIVDIMAKWNRASSCKLSELLSL 285 ea....tvseekagkaswgelfrgrtrpkvrqrllmgvmlqafqQltGiN
                     + +++ ++|+++++|+      ||  +++    + |+|+++++++
                 286 DLqgpvSNSPTEVQKHNLSYLFYNWS---ITKRTLTVWLIWFTG------ 326 aifYYsptifksvGvsdsvasllvtiivgvvNf.vFTfvaLiflvDrfGR
                     ++ +||  ++    +++   +|  +++|||  +++  +|+  ||
                 327 SLGFYSFSLNSVNLGGNE---YLNLFLLGVVEIpAYTFVC--IAMDKVGR 371

RplllllGaagmaicflilgasigvallllnkpkdpsskaagivaivfill
                     |+  |+ +++   |+++ ++      ++++|+      |+ +| +++
                 372 RTVLAYSLFCSALACGVV-------MVIPQKH--------YILGVVTAMV 406 fiafFalgwGpipwvilsElFPtkvRskalalataanwlanfiigflfpy
                     ++++  +|  |   +++++|+||   ||+| +   ++ +||+++++   |
                 407 GKFAIGAAFGLIY-LYTAELYPTIVRSLAVGSGSMVCRLASILAP--FSV 453 itgaiglalggyvflvfagllvlfilfvfffvPETkGrtLEeieelf<-*
                     +++|+    +++   +|+| ++|++ + +++||| |+ | + |  +
                 454 DLSSIW----IFIPQLFVGTMALLSGVLTLKLPETLGKRL-ATTWEE   495
```

The sugar transporter domain (IPR001066) consists of twelve transmembrane domains and was initially identified in sugar transporters. This indicates that the sequence of the invention has properties similar to those of other proteins known to contain this domain and similar to the properties of these domains.

In 1994 the first member of the organic cation transporter family, designated as OCT1, was isolated from the rat kidney by expression cloning. Rat (r)OCT1 is comprised of 556 amino acids with 12 putative transmembrane domains. Northern blot analysis showed that rOCT1 mRNA was expressed in the liver, kidney, and intestine. In the kidney, rOCT1 mRNA was detected in proximal tubules, glomeruli, and cortical collecting ducts, but not in distal tubules. By immunohistochemical analysis, rOCT1 was localized to the basolateral membranes of S1 and S2 segments of proximal renal tubules and the small intestine and liver. When expressed in oocytes, rOCT1 stimulated uptake of TEA, which was inhibited by diverse organic cations. Electrophysiological experiments using rOCT1-expressing oocytes under voltage-clamped conditions demonstrated that positive inward currents were induced when TEA, NMN, choline, dopamine, or MPP were added to the bath medium, indicating that rOCT1-mediated cation uptake is electrogenic.

Human (h) OCT1 is comprised of 554 amino acids and shows 78% identity with rOCT1. Its mRNA transcript was detected exclusively in the liver. There are distinct species differences in tissue distribution and histochemical localization of OCT1. After expression in oocytes, hOCT1 mediated the uptake of type 1 organic cations such as NMN, TEA, and MPP, suggesting that hOCT1 may primarily participate in hepatic excretion of organic cations in humans. hOCT1-mediated MPP uptake was saturable with a Km value of 14.6 mmol/L and was sensitive to transmembrane potential. The type 2 hydrophobic cations such as vecuronium and decynium-22 as well as the type 1 hydrophilic cations such as TEA and NMN inhibited MPP uptake. hOCT1 has lower binding affinity for several cations such as decynium-22, tetrapentylammonium, quinine, and NMN than rOCT1, indicating species differences in the substrate specificity. The human genes of hOCT1 and hOCT2 (also named SLC22A1 and SLC22A2) have been localized in close proximity on chromosome 6q26.

Since OCT1 was cloned, other gene products with significant homology to OCT1 have been identified. Using hybridization techniques, we isolated a cDNA encoding OCT2 from rat kidney. rOCT2 is comprised of 593 amino acids with 12 proposed putative transmembrane domains showing a 67% identity to rOCT1. On Northern hybridization and RT-PCR analysis, the rOCT2 mRNA transcript was detected predominantly in the kidney, at higher levels in the medulla than the cortex, but not in the liver, lung, or intestine. When rOCT2 was expressed in oocytes, uptake of TEA was suppressed by the replacement of Na+ with K+, suggesting that the uptake was membrane potential-dependent. Acidification of extracellular medium resulted in a decreased uptake of TEA, whereas the efflux of TEA out of rOCT1- and rOCT2-expressing oocytes was not stimulated by the inward H+ gradient. To compare the functional characteristics of rOCT1 and rOCT2, we established stable transfectants using MDCK cells. TEA uptake by both rOCT1 and rOCT2 transfectants grown on microporous membrane filters was markedly enhanced when TEA was added to the basolateral bath medium, but not to the apical medium. TEA uptake by both transfectants was decreased by acidifying the medium pH, suggesting that rOCT1- and rOCT2-mediated TEA transport were pH sensitive. Efflux of TEA out of the transfectants was unaffected or moderately inhibited by acidification of the medium. Structurally diverse organic cations, including the type 1 cations such as MPP, cimetidine, NMN, nicotine, and procainamide, and type 2 cations, such as quinine and quinidine, inhibited TEA uptake in the transfectants. Inhibition experiments suggested that rOCT1 and rOCT2 had similar inhibitor binding affinities for many compounds, but showed moderate differences in inhibitor sensitivity for several compounds such as MPP, procainamide, dopamine, and testosterone by a factor of 2 to 3. rOCT2 and hOCT2, which share 80% amino acid identity, have been shown to accept monoamine neurotransmitters such as dopamine, norepinephrine, epinephrine, 5-hydroxytryptamine, and amantadine as substrates. These findings raise the possibility that OCT2 plays a physiological role in renal handling of some bioactive monoamines and implies that the transporter is indirectly involved in the physiological function of these monoamines such as renal tubular reabsorption of Na+.

Recently, it was reported that slices and isolated basolateral membrane vesicles of male rat kidney showed a higher transport activity for TEA than those of female rat kidney. The expression levels of rOCT2 mRNA and the protein in the kidney of males were much higher than those in females. There was no gender difference in mRNA expression levels of rOCT1. These findings suggested that rOCT2 is responsible for the gender differences in renal basolateral membrane organic cation transport activity.

A cDNA encoding an additional member of the OCT gene family, designated as OCT3, was isolated from the rat placenta. rOCT3 is comprised of 551 amino acids with 12 putative transmembrane domains and shows 48% identity to rOCT1. Northern blot analysis indicated that rOCT3 mRNA was detected most abundantly in the placenta and moderately in the intestine, heart, and brain. Expression of rOCT3 mRNA was comparatively low in the kidney and lung, and it was not detected in the liver. When expressed in HeLa cells and *Xenopus* oocytes, rOCT3 induced uptake of TEA and guanidine, which could be inhibited by MPP. Under voltage-clamped conditions, rOCT3-mediated TEA uptake evoked a potential-dependent inward current. The current induced by the TEA uptake was markedly influenced by extracellular pH. However, such pH dependence of TEA uptake by rOCT3-expressing oocytes could not be confirmed under voltage clamp conditions. Therefore, rOCT3 appears to be a potential-sensitive and pH gradient-independent organic cation transporter. Although the distribution and localization of rOCT3 in the kidney have not yet been determined, it may also participate in the renal handling of a variety of organic cations.

By their homology to OCT transporters, two additional members of the OCT gene family, named hOCTN1 (SLC22A4) and hOCTN2 (SLC22A5), have been identified. A cDNA encoding hOCTN1 was cloned from human fetal liver and encodes 551 amino acid residue protein with 1 putative transmembrane domains and one nucleotide binding site motif. hOCTN1 mRNA was found to be abundant in the kidney, trachea, bone marrow, fetal liver and several human cancer cell lines, but not in adult liver. When expressed in HEK293 cells, hOCTN1 mediated saturable and pH-dependent uptake of TEA with higher activity at neutral and alkaline than at acidic pH. In addition, the efflux of TEA out of the cells was pH-dependent, with an accelerated rate at acidic external medium pH. TEA uptake was not influenced by membrane potential, and hOCTN1-mediated TEA uptake was inhibited by other organic cations such as cimetidine, procainamide, quinidine, quinine, and verapamil. When expressed in oocytes, hOCTN1 stimulated uptake of quinidine, verapamil, and zwitterionic L-carnitine. The functional role of OCTN1 in the renal secretion of organic cations remains unknown.

hOCTN2 was identified as a homologue of hOCTN1 from human kidney. hOCTN2 cDNA encodes a 557-amino acid residue protein with 76% similarity to hOCTN1. hOCTN2 is strongly expressed in the kidney, trachea, spleen, bone marrow, skeletal muscle, heart, and placenta in adult humans. When expressed in HEK293 cells, hOCTN2 mediated the uptake of L-carnitine in a Na+-dependent manner with a Km value of 4.3 mmol/L, whereas it mediated some minor uptake of TEA and guanidine. The physiological function of hOCTN2 is suggested to be a high-affinity Na+-carnitine cotransporter. It was reported that primary systemic carnitine deficiency, which is an autosomal recessive disease characterized by low serum and intracellular concentrations of carnitine, is caused by mutations in the hOCTN2 gene.

Interestingly, it was recently reported that rOCTN2 is a Na+-independent organic cation transporter as well as a Na+-dependent carnitine transporter, which is expressed in the heart, kidney, placenta, and brain. In rat kidney, rOCTN2 mRNA is predominantly expressed in the cortex, while there is very little expression in the medulla. In the cortical region, rOCTN2 mRNA was found in the proximal and distal tubules. There have been two mutations reported that result in amino acid substitution in OCTN2, P478L (hOCTN2) and L352R (mouse OCTN2). These mutations in hOCTN2 cause complete loss of carnitine transport function. In contrast, only the M352R mutant appeared to be associated with complete loss of organic cation transport function, whereas the P478L mutant had higher organic cation transport activity than the wild-type transporter. These studies suggested that the binding sites for carnitine and organic cations in OCTN2 exhibit significant overlap but are not identical. Therefore, there may be clinical implications for pharmacotherapy in individual patients with primary carnitine deficiency if the mutations in OCTN2 also affect organic cation transport activity.

The organic cation transporter family is critical in the elimination of many endogenous amines as well as drugs and environmental toxin. Members of this family are usually expressed in the kidney, liver and small intestine. Gründemann et al (Nature 372: 549–552, 1994) identified the first member of the organic cation transporter family, designated as OCT1, from the rat kidney by expression cloning. rOCT1 is comprised of 556 amino acids with 12 putative transmembrane domains and is expressed in the liver, kidney, intestine and colon. When expressed in oocytes, rOCT1 stimulated uptake of TEA, which was inhibited by diverse organic cations. Electrophysiological experiments using rOCT1-expressing oocytes under voltage-clamped conditions demonstrated that positive inward currents were induced when TEA, NMN, choline, dopamine, or MPP were added to the bath medium, indicating that rOCT1-mediated cation uptake is electrogenic.

Human hOCT1 is comprised of 554 amino acids and shows 78% identity with rOCT1 (Zhang et al., *Molec. Pharm.* 51: 913–921, 1997). Its mRNA transcript was detected exclusively in the liver. There are distinct species differences in tissue distribution and histochemical localization of OCT1. After expression in oocytes, hOCT1 mediated the uptake of type 1 organic cations such as NMN, TEA, and MPP, suggesting that hOCT1 may primarily participate in hepatic excretion of organic cations in humans. hOCT1 seems to differ in its substrate specificity relative to rOCT1. The human genes of hOCT1 and hOCT2 (also named SLC22A1 and SLC22A2) have been localized in close proximity on chromosome 6q26.

Since OCT1 was cloned, other gene products with significant homology to OCT1 have been identified. rOCT2, isolated from rat kidney, has a 67% identity to rOCT1 (Okuda et al., *Biochem Biophys Res Commun* 224(2):500–7, 1996). It is detected predominantly in the kidney, at higher levels in the medulla than the cortex, but not in the liver, lung, or intestine. rOCT2 seems to play a physiological role in renal handling of some bioactive monoamines. A cDNA encoding an additional member of the OCT gene family, designated as OCT3, was isolated from the rat placenta (Kekuda et al., *J Biol Chem* 273(26):15971–9, 1998). rOCT3 is comprised of 551 amino acids with 12 putative transmembrane domains and shows 48% identity to rOCT1. Northern blot analysis indicated that rOCT3 mRNA was detected most abundantly in the placenta and moderately in the intestine, heart, and brain. Expression of rOCT3 mRNA was comparatively low in the kidney and lung, and it was not detected in the liver. rOCT3 is a potential-sensitive and pH gradient-independent organic cation transporter.

By their homology to OCT transporters, two additional members of the OCT gene family, named hOCTN1 (SLC22A4; Tamai et al., *FEBS Lett* 419(1):107–11, 1997) and hOCTN2 (SLC22A5; Wu et al., *Biochem Biophys Res Commun* 246(3):589–95, 1998) have also been identified. hOCTN1 mRNA was found to be abundant in the kidney, trachea, bone marrow, fetal liver and several human cancer cell lines, but not in adult liver. hOCTN2 is strongly expressed in the kidney, trachea, spleen, bone marrow, skeletal muscle, heart, and placenta in adult humans. The physiological function of hOCTN2 is suggested to be a high-affinity Na+-carnitine cotransporter. It has been reported that primary systemic carnitine deficiency, an autosomal recessive disease characterized by low serum and intracellular concentrations of carnitine, is caused by mutations in the hOCTN2 gene (Wang et al., *Hum Mutat* 16(5): 401–7, 2000).

NOV14

NOV14 includes two novel D-beta Hydroxybutyrate Dehydrogenase-like proteins disclosed below. The disclosed sequences have been named NOV14a and NOV14b. Unless specifically addressed as NOV14a or NOV14b, any reference to NOV14 is assumed to encompass all variants.

NOV14a

A disclosed NOV14a nucleic acid of 1192 nucleotides (also referred to as CG56001-01) (SEQ ID NO:31) encoding a novel D-beta-hydroxybutyrate dehydrogenase-like protein is shown in Table 14A. An open reading frame was identified beginning with an ATG initiation codon at nucleotides 69–71 and ending with a TGA codon at nucleotides 1098–1100. Putative untranslated regions upstream from the initiation codon and downstream from the termination codon are underlined. The start and stop codons are in bold in Table 14A.

TABLE 14A

NOV14a nucleotide sequence (SEQ ID NO:31)
<u>TGCTGAGGGTGCATTTATGTTTCAGAACCACCGGGAGGAACTGGGCCATT</u>

<u>CTAACACCCGTTGCTACC</u>ATGCTGGCCACCCGCCTCTCCAGACCCCTGTC

TABLE 14A-continued

NOV14a nucleotide sequence

ACGGCTCCCAGGAAAAAACCCTAAGTGCCTGTGATAGAGAAAATGGAGCA

AGGCGCCCACTATTGCTTGGTTCTACTTCCTTTATCCCGATTGGCCGTCG

GACTTATGCCAGTGCGGCGGAGCCGGTGAGTGGAAAAGCTGTCCTGGTCA

CAGGCTGTGACTCTGGATTTGGGTTCTCATTGGCCAAGCATCTGCATTCA

AAAGGCTTCCTTGTGTTTGCTGGCTGCTTGATGAAGGACAAAGGCCATGA

TGGGGTCAAGGAGCTGGACAGCCTAAACAGTGACCGATTGAGAACCGTCC

AGCTCAATGTCTGCAGCAGCGAAGAGGTGGAGAAAGTGGTGGAGATTGTC

CGCTCGAGCCTGAAGGACCCTGAGAAAGGTATGTGGGGCCTCGTTAACAA

TGCCGGCATCTCAACGTTCGGGGAGGTGGAGTTCACCAGCCTGGAGACCT

ACAAGCAGGTGGCAGAAGTGAACCTTTGGGGCACAGTGCGGATGACGAAA

TCCTTTCTCCCCCTCATCCGAAGGGCCAAAGGTCGCGTCGTCAATATCAG

CAGCATGCTGGGCCGCATGGCCAACCCGGCCCGCTCCCCGTACTGCATCA

CCAAGTTCGGGGTAGAGGCTTTCTCGGACTGCCTGCGCTATGAGATGTAC

CCCCTGGGCGTGAAGGTCAGCGTGGTGGAGCCCGGCAACTTCATCGCTGC

CACCAGCCTTTACAGCCCTGAGAGCATTCAGGCCATCGCCAAGAAGATGT

GGGAGGAGCTGCCTGAGGTCGTGCGCAAGGACTACGGCAAGAAGTACTTT

GATGAAAAGATCGCCAAGATGGAGACCTACTGCAGCAGTGGCTCCACAGA

CACGTCCCCTGTCATCGATGCTGTCACACACGCCCTGACCGCCACCACCC

CCTACACCCGCTACCACCCCATGGACTACTACTGGTGGCTGCGAATGCAG

ATCATGACCCACTTGCCTGGAGCCATCTCCGACATGATCTACATCCGCTG

AAGAGTCTCGCTGTGGCCTCTGTCAGGGATCCCTGGTGGAAGGGAGGGG

AGGGAGGAACCCATATAGTCAACTCTTGATTATCCACGTGTGG

The human D-beta-hydroxybutyrate dehydrogenase-like NOV14a disclosed in this invention maps to chromosome 3.

In a search of sequence databases, it was found, for example, that the nucleic acid sequence of this invention has 958 of 1145 bases (83%) identical to a gb:GENBANK-ID: RATDBHYDEH|acc:M89902.1 mRNA from *Rattus norvegicus* (Sprague-Dawley D-beta-hydroxybutyrate dehydrogenase mRNA, complete cds).

A disclosed NOV14a polypeptide (SEQ ID NO:32) encoded by SEQ ID NO:31 has 343 amino acid residues and is presented in Table 14B using the one-letter code. Although SignalP suggests that the human D-beta-hydroxybutyrate dehydrogenase may have a signal peptide, Psort predicts that it is localized in to mitochondria. Because it is similar to the human hydroxybutyrate dehydrogenase family, some members of which are expected to have mitochondrial localization. Therefore it is likely that this novel human D-beta-hydroxybutyrate dehydrogenase is available at the same sub-cellular localization and hence accessible to a diagnostic probe and for various therapeutic applications. Nonetheless, the SignalP, Psort and/or Hydropathy results predict that NOV14a is likely to be localized to the mitochondrial matrix space with a certainty of 0.6723. In an alternative embodiment, NOV14 is likely to be localized to the microbody (peroxisome) with a certainty of 0.3942, or to the mitochondrial inner membrane with a certainty of 0.3622, or to the mitochondrial intermembrane space with a certainty of 0.3622. According to SignalP data the most likely cleavage site is between amino acids 12 and 13, i.e., at the dash in the sequence LSR-LP.

TABLE 14B

NOV14a protein sequence (SEQ ID NO:32)
MLATRLSRPLSRLPGKTLSACDRENGARRPLLLGSTSFIPIGRRTYASAA

EPVSGKAVLVTGCDSGFGFSLAKHLHSKGFLVFAGCLMKDKGHDGVKELD

SLNSDRLRTVQLNVCSSEEVEKVVEIVRSSLKDPEKGMWGLVNNAGISTF

GEVEFTSLETYKQVAEVNLWGTVRMTKSFLPLIRRAKGRVVNISSMLGRM

ANPARSPYCITKFGVEAFSDCLRYEMYPLGVKVSVVEPGNFIAATSLYSP

ESIQAIAKKMWEELPEVVRKDYGKKYFDEKIAKMETYCSSGSTDTSPVID

AVTHALTATTPYTRYHPMDYYWWLRMQIMTHLPGAISDMIYIR

The full amino acid sequence of the protein of the invention was found to have 297 of 342 amino acid residues (86%) identical to, and 313 of 342 amino acid residues (91%) similar to, the 344 amino acid residue ptnr:SWIS-SPROT-ACC:P29147 protein from *Rattus norvegicus* (Rat) (D-BETA-HYDROXYBUTYRATE DEHYDROGENASE PRECURSOR (EC 1.1.1.30) (BDH) (3-HYDROXYBU-TYRATE DEHYDROGENASE)).

The human D-beta-hydroxybutyrate dehydrogenase disclosed in this invention is expressed in at least the following tissues: brain, eye, colon, kidney, liver, spleen, lung, breast, ovary, testis, genitourinary track, lymph, T-cell, B-cell. In addition, the sequence is predicted to be expressed in the heart because of the expression pattern of (GENBANK-ID: gb:GENBANK-ID:RATDBHYDEH|acc:M89902.1) a closely related Sprague-Dawley D-beta-hydroxybutyrate dehydrogenase mRNA, complete cds homolog in species *Rattus norvegicus*.

The nucleic acids and proteins of the invention are useful in potential diagnostic and therapeutic applications implicated in various diseases and disorders described below and/or other pathologies. For example, the compositions of the present invention will have efficacy for treatment of patients suffering from diabetes, obesity, and other diseases, disorders and conditions of the like.

NOV14b

A disclosed NOV14b nucleic acid of 1166 nucleotides (also referred to as CG56001-02) (SEQ ID NO:33) encoding a novel D-beta-hydroxybutyrate dehydrogenase-like protein is shown in Table 14C. An open reading frame was identified beginning with an ATG initiation codon at nucleotides 69–71 and ending with a TGA codon at nucleotides 1098–1100. Putative untranslated regions upstream from the initiation codon and downstream from the termination codon are underlined. The start and stop codons are in bold in Table 14C.

TABLE 14C

NOV14b nucleotide sequence (SEQ ID NO:33)

TGCTGAGGGTGCATTTATGTTTCAGAACCACCGGGAGGAACTGGGCCATT
CTAACACCCGTTGCTACCATGCTGGCCACCCGCCTCTCCAGACCCCTGTC
ACGGCTCCCAGGAAAAACCCTAAGTGCCTGTGATAGAGAAAATGGAGCAA
GACGCCCACTATTGCTTGGTTCTACTTCCTTTATCCCGATTGGCCGTCGG
ACTTATGCCAGTGCGGCGGAGCCGGTTGGCAGCAAAGCTGTCCTGGTCAC
AGGCTGTGACTCTGGATTTGGGTTCTCATTGGCCAAGCATCTGCATTCAA
AAGGCTTCCTTGTGTTTGCTGGCTGCTTGATGAAGGACAAAGGCCATGAT
GGGGTCAAGGAGCTGGACAGCCTAAACAGTGACCGATTGAGAACCGTCCA
GCTCAATGTCTGCAGCAGCAAGAGGTGGAGAAAGTGGTGGAGATTGTCC
GCTCGAGCCTGAAGGACCCTGAGAAAGGCATGTGGGGCCTCGTTAACAAT
GCCGGCATCTCAACGTTCGGGGAGGTGGAGTTAACCAGCCTGGAGACCTA
CAAGCAGGTGGCAGAAGTGAACCTTTGGGGCACAGTGCGGATGACGAAAT
CCTTTCTCCCCCTCATCCGAAGGGCCAAAGGCCGCGTCGTCAATATCAGC
AGCATGCTGGGCCGCATGGCCAACCCGGCCCGCTCCCCGTACTGCATCAC
CAAGTTCGGGGTAGAGGCTTTCTCGGACTGCCTGCGCTATGAGATGTACC
CCCTGGGCGTGAAGGTCAGCGTGGTGGAGCCCGGCAACTTCATCGCTGCC
ACCAGCCTTTACAGCCCTGAGAGCATTCAGGCCATCGCCAAGAAGATGTG
GGAGGAGCTGCCTGAGGTCGTGCGcAGGACTACGGCAAAGAAGTACTTTG
ATGAAAAGATCGCCAAGATGGAGACCTACTGCAGCAGTGGCTCCACAGAC
ACGTCCCCTGTCATCGATGCTGTCACACACGCCCTGACCGCCACCACCCC
CTACACCCGCTACCACCCCATGGACTACTACTGGTGGCTGCGAATGCAGA
TCATGACCCACTTGCCTGGAGCCATCTCCGACATGATCTACATCCGCTGA
AGAGTCTCGCTGTGGCCTCTGTAAGGGATTCCTGGTGGAAGGGGAGGGGA
GGGAGGAACCCATATA

The human D-beta-hydroxybutyrate dehydrogenase-like NOV14b disclosed in this invention maps to chromosome 3.

In a search of sequence databases, it was found, for example, that the nucleic acid sequence of this invention has 933 of 1108 bases (84%) identical to a gb:GENBANK-ID: RATDBHYDEHIacc:M89902.1 mRNA from *Rattus norvegicus* (Sprague-Dawley D-beta-hydroxybutyrate dehydrogenase mRNA, complete cds).

A disclosed NOV14b polypeptide (SEQ ID NO:34) encoded by SEQ ID NO:33 has 343 amino acid residues and is presented in Table 14D using the one-letter code. SignalP, Psort and/or Hydropathy results predict that NOV14a is likely to be localized to the mitochondrial matrix space with a certainty of 0.6723. In an alternative embodiment, NOV14 is likely to be localized to the microbody (peroxisome) with a certainty of 0.3942, or to the mitochondrial inner membrane with a certainty of 0.3622, or to the mitochondrial intermembrane space with a certainty of 0.3622. According to SignalP data the most likely cleavage site is between amino acids 12 and 13, i.e., at the dash in the sequence LSR-LP.

TABLE 14D

NOV14b protein sequence (SEQ ID NO:34)

MLATRLSRPLSRLPGKTLSACDRENGARRPLLLGSTSFIPIGRRTYASAA

EPVGSKAVLVTGCDSGFGFSLAKHLHSKGFLVFAGCLMKDKGHDGVKELD

SLNSDRLRTVQLNVCSSEEVEKVVEIVRSSLKDPEKGMWGLVNNAGISTF

GEVEFTSLETYKQVAEVNLWGTVRMTKSFLPLIRRAKGRVVNISSMLGRM

ANPARSPYCITKFGVEAFSDCLRYEMYPLGVKVSVVEPGNFIAATSLYSP

ESIQAIAKKMWEELPEVVRKDYGKKYFDEKIAKMETYCSSGSTDTSPVID

AVTHALTATTPYTRYHPMDYYWWLRMQIMTHLPGAISDMIYIR

The full amino acid sequence of the protein of the invention was found to have 331 of 344 amino acid residues (96%) identical to, and 333 of 344 amino acid residues (96%) similar to, the 344 amino acid residue ptnr:SWISS-NEW-ACC:Q02338 protein from *Homo sapiens* (Human) (D-BETA-HYDROXYBUTYRATE DEHYDROGENASE PRECURSOR (EC 1.1.1.30) (BDH) (3-HYDROXYBUTYRATE DEHYDROGENASE)).

The D-BETA-HYDROXYBUTYRATE DEHYDROGENASE PRECURSOR-like gene disclosed in this invention is expressed in at least the following tissues: brain, eye, colon, kidney, liver, spleen, lung, breast, ovary, testis, genitourinary track, lymph, T-cell, B-cell. Expression information was derived from the tissue sources of the sequences that were included in the derivation of the sequence of CuraGen Acc. No. CG56001-02. The sequence is predicted to be expressed in the following tissues because of the expression pattern of (GENBANK-ID: gb:GENBANK-ID:RATDBHYDEHIacc: M89902.1) a closely related Sprague-Dawley D-beta-hydroxybutyrate dehydrogenase mRNA, complete cds homolog in species *Rattus norvegicus* heart.

The nucleic acids and proteins of the invention have applications in the diagnosis and/or treatment of various diseases and disorders. For example, the compositions of the present invention will have efficacy for the treatment of patients suffering from: diabetes, obesity as well as other diseases, disorders and conditions.

NOV14a and NOV14b share a high degree of homology as is shown in the amino acid alignment in Table 14E.

Table 14E. Clustal W Alignment of NOV14a and NOV14b

```
                    10        20        30        40        50        60        70        80
              ....|....|....|....|....|....|....|....|....|....|....|....|....|....|....|....|
CG56001_01    MLATRLSRPLSRLPGKTLSACDRENGARRPLLLGSTSFIPIGRRTYASAAEPVSGKAVLVTGCDSGFGFSLAKHLHSKGF
CG56001_02    MLATRLSRPLSRLPGKTLSACDRENGARRPLLLGSTSFIPIGRRTYASAAEPVGSKAVLVTGCDSGFGFSLAKHLHSKGF 90       100       110       120       130       140       150       160
              ....|....|....|....|....|....|....|....|....|....|....|....|....|....|....|....|
CG56001_01    LVFAGCLMKDKGHDGVKELDSLNSDRLRTVQLNVCSSEEVEKVVEIVRSSLKDPEKGMWGLVNNAGISTFGEVEFTSLET
CG56001_02    LVFAGCLMKDKGHDGVKELDSLNSDRLRTVQLNVCSSEEVEKVVEIVRSSLKDPEKGMWGLVNNAGISTFGEVEFTSLET 170       180       190       200       210       220       230       240
              ....|....|....|....|....|....|....|....|....|....|....|....|....|....|....|....|
CG56001_01    YKQVAEVNLWGTVRMTKSFLPLIRRAKGRVVNISSMLGRMANPARSPYCITKFGVEAFSDCLRYEMYPLGVKVSVVEPGN
CG56001_02    YKQVAEVNLWGTVRMTKSFLPLIRRAKGRVVNISSMLGRMANPARSPYCITKFGVEAFSDCLRYEMYPLGVKVSVVEPGN 250       260       270       280       290       300       310       320
              ....|....|....|....|....|....|....|....|....|....|....|....|....|....|....|....|
CG56001_01    FIAATSLYSPESIQAIAKKMWEELPEVVRKDYGKKYFDEKIAKMETYCSSGSTDTSPVIDAVTHALTATTPYTRYHPMDY
CG56001_02    FIAATSLYSPESIQAIAKKMWEELPEVVRKDYGKKYFDEKIAKMETYCSSGSTDTSPVIDAVTHALTATTPYTRYHPMDY 330       340
              ....|....|....|....|...
CG56001_01    YWWLRMQIMTHLPGAISDMIYIR     (SEQ ID NO:32)
CG56001_02    YWWLRMQIMTHLPGAISDMIYIR     (SEQ ID NO:34)
```

In a search of public sequence databases, NOV14 was found to have homology to the amino acid sequences shown in the BLASTP data listed in Table 14F.

TABLE 14F

BLASTP results for NOV14

| Gene Index/ Identifier | Protein/Organism | Length (aa) | Identity (%) | Positives (%) | Expect |
|---|---|---|---|---|---|
| ptnr:SPTREMBL-ACC:Q9BRZ4 | HYPOTHETICAL 38.2 KDA PROTEIN - *Homo sapiens* | 343 | 341/343 (99%) | 341/343 (99%) | 2.0e-182 |
| ptnr:SPTREMBL-ACC:Q96ET1 | UNKNOWN (PROTEIN FOR MGC:9788) - *Homo sapiens* | 343 | 340/343 (99%) | 341/343 (99%) | 4.2e-182 |
| ptnr: SWISSNEW-ACC:Q02338 | D-beta-hydroxybutyrate dehydrogenase, mitochondrial precursor (EC 1.1.1.30) (BDH) (3-hydroxybutyrate dehydrogenase) - *Homo sapiens* | 344 | 329/344 (95%) | 331/344 (96%) | 1.0e-173 |
| ptnr:pir-id:A42845 | 3-hydroxybutyrate dehydrogenase (EC 1.1.1.30) - human | 343 | 319/333 (95%) | 321/333 (96%) | 1.1e-169 |
| ptnr: SWISSNEW-ACC:P29147 | D-beta-hydroxybutyrate dehydrogenase, mitochondrial precursor (EC 1.1.1.30) (BDH) (3-hydroxybutyrate dehydrogenase) - *Rattus norvegicus* | 344 | 297/342 (86%) | 313/342 (91%) | 3.6e-160 |

A multiple sequence alignment is shown in Table 14G, with the protein of the invention being shown on the first line in a ClustalW analysis comparing the protein of the invention with related protein sequences shown in Table 14F.

Table 14G. ClustalW Analysis of NOV14

1) NOV14a CG56001-01 (SEQ ID NO:31)
2) Q9BRZ4 (SEQ ID NO:171)
3) Q96ET1 (SEQ ID NO:172)
4) Q02338 (SEQ ID NO:173)
5) A42845 (SEQ ID NO:174)
6) P29147 (SEQ ID NO:175)

```
                    10         20         30         40         50         60         70         80
             ....|....|....|....|....|....|....|....|....|....|....|....|....|....|....|....|
NOV14a       -MLATRLSRPLSRLPGKTLSACDRENGARRPLLLGSTSFIPIGRRTYASAAEPVSGKAVLVTGCDSGFGFSLAKHLHSKG
Q9BRZ4       -MLATRLSRPLSRLPGKTLSACDRENGARRPLLLGSTSFIPIGRRTYASAAEPVGSKAVLVTGCDSGFGFSLAKHLHSKG
Q96ET1       -MLATRLSRPLSRLPGKTLSACDRENGARRPLLLGSTSFIPIGRRTYASAAEPVGSKAVLVTGCDSGFGFALAKHLHSKG
Q02338       MLATRTLSRPLSRLPGKTLSACDRENGARRPLLLGSTSFIPIGRRTYASAAEPVGSKAVLVTGCDSGFGFSLAKHLHSKG
A42845       GLRPPPPGR-FSRLPGKTLSACDRENGARRPLLLGSTSFIPIGRRTYASAAEPVGSKAVLVTGCDSGFGFSLAKHLHSKG
P29147       MMLAARLSRPLSCLPGKALSVCDRENGTRHTLLFYPASHSPDTRRTYISQADAASGKAVLVTGCDSGFGFSLAKHLHSKG 90        100        110        120        130        140        150        160
             ....|....|....|....|....|....|....|....|....|....|....|....|....|....|....|....|
NOV14a       FLVFAGCLMKDKGHDGVKELDSLNSDRLRTVQLNVCSSEEVEKVVEIVRSSLKDPEKGMWGLVNNAGISTFGEVEFTSLE
Q9BRZ4       FLVFAGCLMKDKGHDGVKELDSLNSDRLRTVQLNVCSSEEVEKVVEIVRSSLKDPEKGMWGLVNNAGISTFGEVEFTSLE
Q96ET1       FLVFAGCLMKDKGHDGVKELDSLNSDRLRTVQLNVCSSEEVEKVVEIVRSSLKDPEKGMWGLVNNAGISTFGEVEFTSLE
Q02338       FLVFAGCLMKDKGHDGVKELDSLNSDRLRTVQLNVFRSEEVEKVVGDCPFEPEGPEKGMWGLVNNAGISTFGEVEFTSLE
A42845       FLVFAGCLMKDKGHDGVKELDSLNSDRLRTVQLNVFRSEEVEKVVGDCPFEPEGPEKGMWGLVNNAGISTFGEVEFTSLE
P29147       FLVFAGCLEKEQGDAGVRELDSLKSDRLRTIQLNVCNSEEVEKAVEIVRSCLKDPEKGMWGLVNNAGISTFGEVEFTSME 170        180        190        200        210        220        230        240
             ....|....|....|....|....|....|....|....|....|....|....|....|....|....|....|....|
NOV14a       TYKQVAEVNLWGTVRMTKSFLPLIRRAKGRVVNISSMLGRMANPARSPYCITKFGVEAFSDCLRYEMYPLGVKVSVVEPG
Q9BRZ4       TYKQVAEVNLWGTVRMTKSFLPLIRRAKGRVVNISSMLGRMANPARSPYCITKFGVEAFSDCLRYEMYPLGVKVSVVEPG
Q96ET1       TYKQVAEVNLWGTVRMTKSFLPLIRRAKGRVVNISSMLGRMANPARSPYCITKFGVEAFSDCLRYEMYPLGVKVSVVEPG
Q02338       TYKQVAEVNLWGTVRMTKSFLPLIRRAKGRVVNISSMLGRMANPARSPYCITKFGVEAFSDCLRYEMYPLGVKVSVVEPG
A42845       TYKQVAEVNLWGTVRMTKSFLPLIRRAKGRVVNISSMLGRMANPARSPYCITKFGVEAFSDCLRYEMYPLGVKVSVVEPG
P29147       TYKQVAEVNLWGTVRITKSFLPLVRRAKGRVVNISSMLGRMANPARSPYCITKFGVEAFSDCLRYEMHPLGVKVSVVEPG 250        260        270        280        290        300        310        320
             ....|....|....|....|....|....|....|....|....|....|....|....|....|....|....|....|
NOV14a       NFIAATSLYSPESIQAIAKKMWEELPEVVRKDYGKKYFDEKIAKMETYCSSGSTDTSPVIDAVTHALTATTPYTRYHPMD
Q9BRZ4       NFIAATSLYSPESIQAIAKKMWEELPEVVRKDYGKKYFDEKIAKMETYCSSGSTDTSPVIDAVTHALTATTPYTRYHPMD
Q96ET1       NFIAATSLYSPESIQAIAKKMWEELPEVVRKDYGKKYFDEKIAKMETYCSSGSTDTSPVIDAVTHALTATTPYTRYHPMD
Q02338       NFIAATSLYNPESIQAIAKKMWEELPEVVRKDYGKKYFDEKIAKMETYCSSGSTDTSPVIDAVTHALTATTPYTRYHPMD
A42845       NFIAATSLYNPESIQAIAKKMWEELPEVVRKDYGKKYFDEKIAKMETYCSSGSTDTSPVIDAVTHALTATTPYTRYHPMD
```

```
P29147   NFIAATSLYSPERIQAIAKKMWDELPEVVRKDYGKKYFDEKIAKMETYCNSGSTDTSSVINAVTHALTAATPYTRYHPMD 330       340
             ....|....|....|....|....
NOV14a    YYWWLRMQIMTHLPGAISDMIYIR
Q9BRZ4    YYWWLRMQIMTHLPGAISDMIYIR
Q96ET1    YYWWLRMQIMTHLPGAISDMIYIR
Q02338    YYWWLRMQIMTHLPGAISDMIYIR
A42845    YYWWLRMQIMTHLPGAISDMIYIR
P29147    YYWWLRMQVMTHFPGAISDKIYIH
```

Other BLAST results include sequences from the Patp database, which is a proprietary database that contains sequences published in patents and patent publications. Patp results include those listed in Table 14H.

TABLE 14H

Patp BLASTP Analysis for NOV14

| Sequences producing High-scoring Segment Pairs | Protein/Organism | Length (aa) | Identity (%) | Positive (%) | E Value |
|---|---|---|---|---|---|
| patp:AAM78804 | Human protein SEQ ID NO 1466 - *Homo sapiens* | 343 | 341/343 (99%) | 341/343 (99%) | 1.6e-182 |
| patp:AAM79788 | Human protein SEQ ID NO 3434 - *Homo sapiens* | 404 | 323/334 (96%) | 324/334 (97%) | 3.0e-172 |
| patp:AAW88492 | Human liver clone HP01299-encoded polypeptide - *Homo sapiens* | 317 | 117/288 (40%) | 177/288 (61%) | 1.8e-48 |
| patp:AAB56678 | Human prostate cancer antigen protein sequence SEQ ID NO:1256 - *Homo sapiens* | 378 | 116/288 (40%) | 176/288 (61%) | 6.0e-48 |
| patp:AAW18334 | Murine liver p32 11-cis-retinol dehydrogenase - *Mus musculus* | 316 | 109/260 (41%) | 156/260 (60%) | 1.2e-47 |

Table 14I lists the domain description from DOMAIN analysis results against NOV14.

TABLE 14I

Domain Analysis of NOV14

Pfam analysis

| Model | Domain | seq-f | seq-t | hmm-f | hmm-t | score | E-value |
|---|---|---|---|---|---|---|---|
| adh_short | 1/1 | 54 | 336 | . . . 1 | 271 [ ] | 268.1 | 1.2e-76 |

Alignments of top-scoring domains:

```
adh_short: domain 1 of 1, from 54 to 336: score 268.1, E = 1.2e-76
(SEQ ID NO:176)
NOV145a(SEQ ID NO:372)  54  tgKvaLvTGassGIGlaiAkrLakeGakVvvvdrreekaeqvaaelk
                                +||++|||  |++||  |+|+  +||+|+++|+    |+++++ ++|+  +++||
                            SGCAVLVTGCDSGFGFSLAKHLHSKGFLVFAGCLMKDKGHDGVKELD 100 aelGdralfiqlDvtdeeqvkaavaqaverlGd...rlDvLVNNAGilgp
                            +++  ||++++|||+|++  |+|+++|+ +++  |  |++++ ++|||||||||+++
                        101 SLNSDRLRTVQLNVCSSEEVEKVVEIVRSSLKDpekGMWGLVNNAGISTF 150 gppfeelseedwervidvNltGvflltqavlpamdhmlkrkgGrIvNisS
                            |+++      |+|++++|  +|||||+|++++|+++|]     +++|++||+|||||
                        151 GEVEF-TSLETYKQVAEVNLWGTVRMTKSFLP----LIRRAKGRVVNISS 195 vaGlnvgvpglsaYsASKaavigltrsLAlElaphgtgIrVnavaPGgvd
                            + |+ +++|++|+|+ +|++|++++++|+ |++|  |   ++|++|  || +
                        196 MLGR-MANPARSPYCITKFGVEAFSDCLRYEMYPLG--VKVSVVEPGNFI 242

T..dmtkalrsrlieakkk.v.re.v.adiadpeleerits.titplgry
                                 +++    + +  |++|++++ +|   |++|+ +++++|+|++ ++ ++   +
                        243 AatSLYSPESIQAIAKKMWeELPEvVrKDYGKKYFDEKIAKmET-YCSSG 291 gvtpeeianavlfLasdgasys..........vtggtlnvdggl<-*
                             ++ + + +||  + +++  +|++ ++ +     ++ +++++ |++
                        292 STDTSPVIDAVTHALTATTPYTryhpmdyywwlRMQIMTHLPGAI    336
```

The short-chain dehydrogenases/reductases family (SDR) is a very large family of enzymes, most of which are known to be NAD- or NADP-dependent oxidoreductases. As the first member of this family to be characterized was *Drosophila* alcohol dehydrogenase, this family used to be called 'insect-type', or 'short-chain' alcohol dehydrogenases. Most members of this family are proteins of about 250 to 300 amino acid residues. Most dehydrogenases possess at least two domains, the first binding the coenzyme, often NAD, and the second binding the substrate. This latter domain determines the substrate specificity and contains amino acids involved in catalysis. Little sequence similarity has been found in the coenzyme binding domain although there is a large degree of structural similarity, and it has therefore been suggested that the structure of dehydrogenases has arisen through gene fusion of a common ancestral coenzyme nucleotide sequence with various substrate specific domains.

This family should always be found adjacent to [INTERPRO:IPR002198], which is a general family of Short-chain dehydrogenases and reductases. A match to this extension indicates that the protein is probably an alcohol dehydrogenase.

This indicates that the sequence of the invention has properties similar to those of other proteins known to contain this/these domain(s) and similar to the properties of these domains.

(R)-3-hydroxybutyrate dehydrogenase (BDH) is a mitochondrial membrane enzyme with an absolute and specific requirement for phosphatidylcholine, which acts as an allosteric activator of BDH enzymatic activity. BDH has served as a prototype for lipid-requiring enzymes. By screening a human heart cDNA library with degenerate oligonucleotides based on peptide sequences from purified bovine BDH, cDNAs encoding BDH (fragment, missing N-terminal) have been isolated. The deduced 343-amino acid protein contains a 46-residue leader peptide, which is cleaved to produce the mature form. Sequence analysis revealed that the first two-thirds of the BDH protein is homologous to short-chain alcohol dehydrogenases (SCADHs), with the homology encompassing the putative coenzyme-binding and active sites of the SCADHs; this region of BDH also has the predicted secondary structure motif of alternating alpha-helices and beta-sheets that is characteristic of SCADHs. The data suggests that the remainder of the BDH protein contains elements that form the substrate- and lipid-binding sites. Northern blot analysis revealed that BDH is expressed in rabbit heart tissue.

The novel human D-beta-hydroxybutyrate dehydrogenase Protein of the invention has 95% homology to (R)-3-hydroxybutyrate dehydrogenase (BDH) described by Marks et al. Therefore it is anticipated that this novel protein has a role in the regulation of essentially all cellular functions and could be a potentially important target for drugs. Such drugs may have important therapeutic applications, such as treating diabetes and obesity diseases. See, Marks, A. R., et al., *J. Biol. Chem.* 267: 15459–15463, 1992.

NOV15

NOV15 includes four novel TEN-M3-like proteins disclosed below. The disclosed sequences have been named NOV15a, NOV15b, NOV15c, and NOV15d. Unless specifically addressed as NOV15a, NOV15b, NOV15c, or NOV15d, any reference to NOV15 is assumed to encompass all variants.

NOV15a

A disclosed NOV15a nucleic acid of 8675 nucleotides (also referred to as SC145665404_A or CG55069-01) (SEQ ID NO:35) encoding a novel TEN-M3-like protein is shown in Table 15A. An open reading frame was identified beginning with an ATG initiation codon at nucleotides 151–153 and ending with a TAA codon at nucleotides 8326–8328. Putative untranslated regions upstream from the initiation codon and downstream from the termination codon are underlined and the start and stop codons are in bold in Table 15A.

TABLE 15A

NOV15a nucleotide sequence (SEQ ID NO:35)

TTTGGCCTCGGGCCAGAATTCGGCACGAGGGGTCTGGAGCTTGGAGGAGAAGTCTGAACTAAGGATAAAC

TAAGAGAGGCCAATGAGACTTGAACCCTGAGCCTAAGTTGTCACCAGCAGGACTGATGTGACACACAGAA

GGAATGAAGTATGGATGTGAAGAACGCAGGCCTTACTGCTCCCTGACCAAGAGCAGACGAAGAGAAGGAA

CGGCGCTACACAAATTCCTCCGCAGACAATGAGGAGTGCCGGGTACCCACACAGAAGTCCTACAGTTCCA

GCGAGACATTGAAAGCTTTTGATCATGATTCCTCGCGGCTGCTTTACGGCAACAGAGTGAAGGATTTGGT

TCAAGAGAAGCAGACGAGTTCACTAGACAAGGACAGAATTTTACCCTAAAGGCAGTTAGGAGTTTGTGAA

CCAGCAACTCCAAGAGGACTGGCATTTTGTGCGGAAATGGGGCTCCCTCACAGAGGTTACTCTATCAGTG

CAGGGTCAGATGCTGATACTGAAAATGAAGCAGTGATGTCCCCAGAGCATGCCATGAGACTTTGGGGCAG

GGGGGTCAAATCAGGCCGCAGCTCCTGCCTGTCAAGTCGGTCCAACTCAGCCCTCACCCTGACAGATACG

GAGCACGAAAACAAGTCCGACAGTGAGAATGAGCAACCTGCAAGCAATCAAGGCCAGTCTACCCTGCAGC

CCTTGCCGCCTTCCCATAAGCAGCACTCTGCACAGCATCATCCATCCATCACTTCTCTCAACAGAAACTC

CCTGACCAATAGAAGGAACCAGAGTCCGGCCCCGCCGGCTGCTTTGCCCGCCGAGCTGCAAGAAACACCC

GAGTCCGTCCAGCTGCAGGACAGCTGGGTCCTTGGCAGTAATGTACCACTGGAAAGAAGGCATTTCCTAT

TCAAAACAGGAACAGGTACAACGCCACTGTTCAGTACTGCAACCCCAGGATACACAATGGCATCTGGCTC

TGTTTATTCACCACCTACTCGGCCACTACCTAGAACACCCTATCAAAGAAGTGCTTTTAAATTCAAGAAG

TCTTCAAAGTACTGTAGCTGGAAATGCACTGCACTGTGTGCCGTAGGGGTCTCGGTGCTCCTGGCAATAC

TCCTGTCTTATTTTATAGCAATGCATCTCTTTGGCCTCAACTGGCAGCTACAGCAGACTGAAAATGACAC

TABLE 15A-continued

NOV15a nucleotide sequence

ATTTGAGAATGGAAAAGTGAATTCTGATACCATGCCAACAAACACTGTGTCATTACCTTCTGGAGACAAT
GGAAAATTAGGTGGATTTACGCAAGAAAATAACACCATAGATTCCGGAGAACTTGATATTGGCCGAAGAG
CAATTCAAGAGATTCCTCCCGGGATCTTCTGGAGATCACAGCTCTTCATTGATAAGCCAAAGTTTCTTAA
ATTCAATATCTCTCTTCAGAAGGATGCATTGATTGGAGTATATGGCCGGAAGAAGTTACCGCCTTCCCAT
ACTCAGTCCTCCCCCCAGTATGACTTCGTGGAGCTCCTGGATGGCAGCAGGCTGATTGCCAGAGAGAAGC
GGAGCCTGCTTGAGACGGAGAGAGCCGGGCGGCAGGCGAGATCCGTCAGCCTTCATGAGGCCGGCTTTAT
CCAGTACTTGGATTCTGGAATCTGGCATCTGGCTTTTTATAATGATGGGAAAAATGAAGAGCAGGTGTCT
TTTAATACCATTGTTATAGAGTCTGTGGTGGAATGTCCCCGAAATTGCCATGGAAATGGAGAATGCGTTT
CTGGAACTTGCCATTGTTTTCCAGGATTTCTGGGTCCGGATTGTTCAAGAGCCGCCTGTCCAGTGTTATG
TAGTGGCAACGGGCAGTACTCCAAGGGCCGCTGCCTGTGTTTCAGCGGCTGGAAGGGCACCGAGTGTGAT
GTGCCGACTACCCAGTGTATTGACCCACAGTGTGGGGTCGTGGGATTTGTATCATGGGCTCCTGTGCTT
GCAGCTCAGGATACAAAGGAGAAAGTTGTGAAGAAGCTGACTGTATAGACCCTGGGTGTTCTAATCATGG
TGTGTGTATCCACGGGGAATGTCACTGCAGTCCAGGATGGGGAGGTAGCAATTGTGAAATACTGAAGACC
ATGTGTCCAGACCAGTGCTCCGGCCACGGAACGTATCTTCAAGAAAGTGGCTCCTGCACGTGTGACCCTA
ACTGGACTGGCCCAGACTGCTCAAACGAAATATGTTCTGTGGACTGTGGCTCACACGGCGTTTGAATGGG
GGGGACGTGTCGCTGTGAAGAAGGCTGGACGGGCCCAGCCTGTAATCAGAGAGCCTGCCACCCCCGCTGT
GCCGAGCACGGGACCTGCAAGGATGGCAAGTGTGAATGCAGCCAGGGCTGGAATGGAGAGCACTGAACTA
TCGCTCACTATTTGGATAAGATAGTTAAGACAAAGATAGGATATAAAGAGGGTTGTCCTGGTCTGTGCAA
CAGCAATGGAAGATGTACCCTGGACCAAAATGGCGGACATTGTGTGTGCCAGCCTGGATGGAGAGGAGCA
GGCTGTGACGTAGCCATGGAGACTCTTTGCACAGATAGAAGGACAAATGAAGGAAATGGACTCATTGACT
GCATGGATCCCGATTGCTGCCTACAGAGTTCCTGCCAGAATCAGCCCTATTGTCGGGGACTGCCGGATCC
TCAGGACATCATTAGCCAAAGCCTTCATCGCCTTCTCAAGCAAGCTGCCAAATCCTTTTATGATCGAATC
AGTTTCCTTATAGGATCTGATAGCACCCATGTTATACCTGGAGAAGTCCTTTCAATAAAGAGCCTTGCAT
CTGTCATCAGAGGCCAAGTACTGACTGCTGATGGAACTCCACTTATTGGAGTAAATGTCTCGTTTTTCCA
TTACCCAGAATATGGATATACTATTACCCGCCAGGACGGAATGTTTGAACTTGGTGGCAATGGTGGGGCC
TCTCTACTTTGGTATTTGAACGATCCCCATTCCTCAACTCAGTATCATACTGTGTGGATTCAATGGAATG
TCTTTTATGTGATGGATACCCAGTCATGGAGAAAGAAGAGAATGACATTCCCAGCTGTGATCTGAGTGG
ATTCGTGAGGCCAATCCCATCATTGTGTCATCACCTTTATCAACCTTTTTAAGATCTTCTCCTGAAAGAC
AGTCCCATCATTCCCGAAACACAGGTACTCCACGAGGAAACTACAATTCCAGGAAACAGATTTGAACTCT
CCTACTTGAGTTCCAGAGCTGCAGGGTATAAGTCAGTTCTCAAGATAACCATGACCCAGTCTATTATTCC
ATTTAATTTAATGAAGGTTCATCTTATGGTAGCTGTAGTAGGAAGACTCTTCCAAAAGTGGTTTCCTGCC
TCACCAAACTTGGCCTAATACTTTCATAATGGGATAAACAGATGCATATAATCAGAAGTCTATGGTCTAT
CTGAAGCTGTTGTGTCAGTTGGATATGAGTATGAGTCGTGTTTGGACCTGACTCTGTGGGAAAAGAGGAC
TGCCATTCTGCAGGGCTATGAATTGGATGCGTCCAACATGGGTGGCTGGAAATTAGATAAAAATCACGTG
CTGGATGTACAGAACGGTATACTGTACAAGGGAACGGGGAAAACCAGTTCATCTCCAAAGCAGCCTCCAG
TCGTGAGTAGCATCATGGGCAATGGGCGAAGGCGCAGCATTTCCTGCCCCAGTTGCAATGGTCAAGCTGA
TGGTAACAAGTTACTGGCCCCAGTGGCGCTAGCTTGTGGGATCGATGGCAGTCTGTACGTAGGCGATTTC
ACTACGTGCGGCGGATATTCCCCTTCTGGAATGTAACAAGTGTCTTAGAACTAAAGAAATAAAGATTTTA
GACATAGCAGCAACCCAGCTCATAGATACTACCTTGCAACGGATCCAGTCACGGGAGATCTGTACGTTTC

TABLE 15A-continued

NOV15a nucleotide sequence

TGACACAAACACCCGCAGAATTTATCGCCCAAAGTCACTTACGGGGCAAAAGACTTGACTAAAAATGCA
GAAGTCGTCGCAGGGACAGGGGAGCAATGCCTTCCGTTTGACGAGGCGAGATGTGGGGATGGAGGGAAGG
CCGTGGAAGCCACACTCATGAGTCCCAAAGGAATGGCAGTTGATAAGAATGGATTAATCTACTTTGTTGA
TGGAACCATGATTAGGAAAGTTGACCAAAAATGGAATCATATCAACTCTTCTGGGCTCTACGATTTGACT
TCAGCCAGACCTTTAACTTGTGACACCAGCATGCACATCAGCCAGGTACGTCTGGAATGGCCCACTGACC
TAGCCATTAACCCTATGGATAACTCCATTTATGTCCTGGATAATAATGTAGTTTTACAGATCACTGAAAA
TCGTCAAGTTCGCATTGCTGCTGGACGGCCCATGCACTGTCAGGTTCCCGGAGTGGAATATCCTGTGGGG
AAGCACGCGGTGCAGACAACACTGGAATCAGCCACTGCCATTGCTGTGTCCTAAAGTGGGGTCCTGTACA
TTACTGAAACTGATGAGAAGAAATTAACCGGATAAGGCAGGTCACAAACAGATGGAAGAATCTCCTTAGT
GGCCGGAATACCTTCAGAGTGTGACTGCAAAAATGATGCCAACTGTGACTGTTACAAGAGTGGAGATGGC
TACGCCAAGGATGCCAAACTCAGTGCCCCATCCTCCCTGGCTGCTTCTCCAGATGGTACACTGTATATTG
CAGATCTAGGGAATATCCGGATCCGGGCTGTGTCAAAGAATAAGCCTTTACTTAACTCTATGAACTTCTA
TGAAGTTGCGTCTCCAACTGATCAAGAACTCTACATCTTTGACATCAATGGTACTCACCAATATACTGTA
AGTTTAGTCACTGGTGATTACCTTTACAATTTTAGCTACAGCAATGACAATGATATTACTGCTGTGACAG
ACAGCAATGGCAACACCCTTAGAATTAGACGGGACCCAAATCGCATGCCAGTTCGAGTGGTGTCTCCTGA
TAACCAAGTGATATGGTTGACAATAGGAACAAATGGATGTTTGAAAGGCATGACTGCTCAAGGACTGGAA
TTAGTTTTGTTTACTTACCATGGCAATAGGTGGCCTTTTAGCCACTAAAAGTGATGAACTGGATGGACAA
CGTTTTTTGACTATGACAGTGAAGGTCGTCTGACAAATGTTACGTTTCCAACTGGAGTGGTCACAAACCT
GCATGGGGACATGGACAAGGCTATCACAGTGGACATTGAGTCATCTAGCCGAGAAGAAGATGTCAGAATC
ACTTCAAATCTGTCCTCGATCGATTCTTTCTACACCATGGTTCAGATCAGTTAAGAAACAGCTACAAAGA
TTGGTTATGACGGCTCCCTCAGAATTATCTACGCCAGTGGCCTGGAACTCACACTACAAACAGAGCCGCA
CGTTCTGGCTGGCACCGCTAATCCGACGGTTGCCAAAGAAACATGACTTTGCCTGGCGAGAAACGGTCAA
AACTTGGTGGAATGGAGATTCCGGAAAAGCAAGCCCCAAGGGAAAGTCAATGTCTTTGGCCGCAAGCTCA
GGGTTAATGGCAGAAACCTCCTTTCAGTTGACTTTGATCGAACAACAAAGACAGAAAAGATCTATGACGA
CCACCGTAAATTTCTACTGAGGATCGCCTACGACACGTCTGGGCACCCGACTCTCTGGCTGCCAAGCAGC
AAGCTGATGGCCGTCAATGTCACCTATTCATCCACAGGTCAAATTGCCAGCATCCAGCGAGGCACCACTA
GCGAGAAAGTAGATTATGACGGACAGGGGAGGATCGTGTCTCGGGTCTTTGCTGATGGTAAAACATGGAG
TTACACATATTTAGAAAAGTCCATGGTTCTTCTGCTTCATAGCCAGCGGCAGTACATCTTCGAATACGAT
ATGTGGGACCGCCTGTCTGCCATCACCATGCCCAGTGTGGCTCGCCACACCATGCAGACAATCCGATCCA
TTGGCTACTACCGCACATATACAACCCCCCGGAAGCAACGCCTCAATCATAAACGGACATACAACGAGGA
AGGGCTGCTTCTACAACAGCTTTCTTGGGTACAAGTCGGAGGGGTCTTATTCAATACAGAAAGGAAGACT
AGGCTCTCAGAAATTTTATATGATAGCACAAGAGTCAGTTTTACCTATGATGAAACAGCAGGAGTCCTAA
AGACAGTAAACCTCCAGAGTGATGGTTTTATTTGCACCATTAGATACAGGCAAATTGGTCCCCTGATTGA
CAGGCAGATTTTCCGCTTTAGTGAGATGGGATGGTAAATGCAAGATTTGACTATAGCCTATGACAAAAGC
TTTCGAGTGACCAGCATGCAGGGTGTGATCAATGAAACGCCACTGCCTATTGATCTGTATCAGTTTGATG
ACATTTCTGGCAAGTTGAGCAGTTTGGAAGTTTGGAGTTATATATTATGATATTAAACAAAGATCATTTC
TACAGCTGTAATGACCTATACGAGCACTTTGATGCTCATGGCCGTATCCAAGGAGGATTAATATGAGATA
TTCAGGTCGCTCATGTACTGGATTACAATTCAGTATGATACATGGGTCGGGTAAACCAAGAGAGAGATTA

TABLE 15A-continued

NOV15a nucleotide sequence

AAATAGGGCCCTTTGCCAACACCACCAAATATGCTTATGAATATGATGTTGATGGACAGCTCCAAACAGT

TTACCTCAATGAAAGATAATGTGGCGGTACAACTACGATCTGAAATGGAACCTCCATTTACTGAAACCCA

AGTAACAGTGCGCGTCTGACACCCCTTCGCTATGACCTGCGAGAAAGAATCACTCGACTGGGTGATGTTC

AATATCGGTTGGATGAAGATGGTTTCCTACGTCAAAGGGGCACGGAAATCTTTGAATATAGCTCCAAGGG

GCTTCTAACTCGAGTTTACAGTAAAGGCAGTGGCTGGACAGTGATCTACCGTTATGACGGCCTGGGAAGG

CGTGTTTCTAGCAAAACCAGTCTAGGACAGCACCTGCAGTTTTTTTATGCTGACTTAACTTATCCCACTA

GGATTACTCATGTCTACAACCATTCGAGTTCAGAAATTACCTCCCTGTATTATGATCTCAAAGGACATCT

TTTTGCCATGGAAATCAGCAGTGGGGATGAATTCTATATTGCATCGGATAACACAGGGAAACCACTGGCT

GTGTTCAGTAGCAATGGGCTTATGCTGAAACAGATTCAGTACACTGCATATGGGAAATCTATTTTGACT

CTAATATTGACTTTCCACTGGTATTGGATTTCATGGTGGCCTGTATGACCCACTCACCAAATTAAATCCA

CTTTGGAGAAAGAGATTATGACATTTTGGCAGGACGGTGGACAACACCTGACAATAGAATCTGGAAAAGA

ATTGGGAAGGACCCAGCTCCTTTTAACTTGTACATGTTTAGGAATAACAACCCTGCAAGCAAAATCCATG

ACGTGAAAGATTACATCACAGATGTTAACAGCTGGCTGGTGACATTTGGTTTCCATCTGCACAATGCTAT

TCCTGGATTCCCTGTTCCCATTTGATTTAACAGAACCTTCTTACGAAACTTGTGAAAGAGTCAGAAGTGG

GATGATATACCGCCCATCTTCGGAGTCCAGCAGCAAGTGGCGCGGCAGGCCAAGGCCTTCCTGTCGCTGG

GGAAGATGGCCGAGGTGCAGGTGAGCCGGCGCCGGGCCGGCGGCGCGCAGTCCTGGCTGTGGTTCGCCAC

GGTCAAGTCGCTGATCGGCAAGGGCGTCATGCTGGCCGTCAGCCAGGGCCGCGTGCAGACCAACGTGCTC

ACATCGCCAACGAGGACTGCATCAAGGTGGCGGCCGTGCTCAACAAACGCCTTCTACCTGGAGAACCTGC

ACTTCACCATCGAGGGCAAGGACACGCACTACTTCATCAAGACCACCACGCCCGAGAGCGACCTAAGCAC

GCTGCGGTTGACCAGCGGCCGCAAGGCGCTGGAGAACGGCATCAACGTGACGGTGTCGCAGTCAACCACG

GTGGTGAACGGCAGGACGCGCAGGTTCGCGGACGTGGAGATGCAGTTCGGCGCGCTGGCGCTGCACGTGC

GCTACGGCATGACCCTGGACGAGGAGAAGGCGCGCATCCTGGAGCAGGCGCGGCAGCGCGCGCTCGCCCG

GGCCTGGGCGCGCGAGCAGCAGCGCGTGCGCGACGGCGAGGAGGGCGCGCGCCTCTGGACGGAGGGCGAG

AAGCGGCAGCTGCTGAGCGCCGGCAAGGTGCAGGGCTACGACGGGTACTACGTACTCTCGGTGGAGAAGT

ACCCCGAGCTGGCCGACAGCGCCAACAACATCCAGTTCCTGCGGCAGAGCGAGATCGGCAGGAGGTAACG

CCCGGGCCGCGCCCGCCGAGCCGCTCACGCCCTGCCCACATTGTCCTGTGGCACAACCCGAGTGGGACTC

TCCAACGCCCAAGAGCCTTCCTCCCGGGGAATGAGACTGCTGTTACGACCCACACCAACACCGCGAAAA

CAGGACCGCTTTTTTCCGAATGACCTTAAGGTGATCGGCTTTAACGAATAATGTTTAAAATATGAATAGC

GCTGCACTCAGTCGGACTGAACGTAGCCAGAGGAAAAAAAAATCATCAAGGACAAAGGCCTCGACCTGTT

GCGCTGGGCCGTCTGTTCCTTCTAGGCACTGTATTTAACTAACTTTAAAAAAAAAAAAAAAAAAAG

The TEN-M3 NOV15a disclosed in this invention maps to chromosome 4.

In a search of sequence databases, it was found, for example, that the nucleic acid sequence of this invention has 5307 of 5309 bases (99%) identical to a gb:GENBANK-ID:AB040888|acc:AB040888.1 mRNA from *Homo sapiens* (*Homo sapiens* mRNA for KIAA1455 protein, partial cds).

A disclosed NOV15a polypeptide (SEQ ID NO:36) encoded by SEQ ID NO:35 has 2725 amino acid residues and is presented in Table 15B using the one-letter code.

NOV15a seems to be a Type II (Ncyt Cexo) membrane protein with an INTEGRAL Likelihood of −9.39 for Transmembrane 309–325 (305–337). The SignalP, Psort and/or Hydropathy results predict that NOV15a has no signal peptide and is likely to be localized in the nucleus with a certainty of 0.8000. In an alternative embodiment, NOV15a is likely to be localized to the plasma membrane with a certainty of 0.7900, or to the microbody (peroxisome) with a certainty of 0.3424, or to the Golgi body with a certainty of 0.3000.

TABLE 15B

| NOV15a protein sequence |
| --- |

(SEQ ID NO:36)

MDVKERRPYCSLTKSRREKERRYTNSSADNEECRVPTQKSYSSSETLKAFDHDSSRLLYGNRVKDLVHRE

ADEFTRQGQNFTLRQLGVCEPATRRGLAFCAEMGLPHRGYSISAGSDADTENEAVMSPEHAMRLWGRGVK

SGRSSCLSSRSNSALTLTDTEHENKSDSENEQPASNQGQSTLQPLPPSHKQHSAQHHPSITSLNRNSLTN

RRNQSPAPPAALPAELQTTPESVQLQDSWVLGSNVPLESRHFLFKTGTGTTPLFSTATPGYTMASGSVYS

PPTRPLPRNTLSRSAFKFKKSSKYCSWKCTALCAVGVSVLLAILLSYFIAMHLFGLNWQLQQTENDTFEN

GKVNSDTMPTNTVSLPSGDNGKLGGFTQENNTIDSGELDIGRRAIQEIPPGIFWRSQLFIDQPQFLKFNI

SLQKDALIGVYGRKKLPPSHTQSSPQYDFVELLDGSRLIAREQRSLLETERAGRQARSVSLHEAGFIQYL

DSGIWHLAFYNDGKNAEQVSFNTIVIESVVECPRNCHGNGECVSGTCHCFPGFLGPDCSRAACPVLCSGN

GQYSKGRCLCFSGWKGTECDVPTTQCIDPQCGGRGICIMGSCACSSGYKGESCEEADCIDPGCSNHGVCI

HGECHCSPGWGGSNCEILKTMCPDQCSGHGTYLQESGSCTCDPNWTGPDCSNEICSVDCGSHGVCMGGTC

RCEEGWTGPACNQRACHPRCAEHGTCKDGKCECSQGWNGEHCTIAHYLDKIVKDKIGYKEGCPGLCNSNG

RCTLDQNGGHCVCQPGWRGAGCDVAMETLCTDSKDNEGDGLIDCMDPDCCLQSSCQNQPYCRGLPDPQDI

ISQSLQSPSQQAAKSFYDRISFLIGSDSTHVIPGESPFNKSLASVIRGQVLTADGTPLIGVNVSFFHYPE

YGYTITRQDGMFDLVANGGASLTLVFERSPFLTQYHTVWIPWNVFYVMDTLVMEKEENDIPSCDLSGFVR

PNPIIVSSPLSTFFRSSPEDSPIIPETQVLHEETTIPGTDLKLSYLSSRAAGYKSVLKITMTQSIIPFNL

MKVHLMVAVVGRLFQKWFPASPNLAYTFIWDKTDAYNQKVYGLSEAVVSVGYEYESCLDLTLWEKRTAIL

QGYELDASNMGGWTLDKHHVLDVQNGILYKGNGENQFISQQPPVVSSIMGNGRRRSISCPSCNGQADGNK

LLAPVALACGIDGSLYVGDFNYVRRIFPSGNVTSVLELRNKDFRHSSNPAHRYYLATDPVTGDLYVSDTN

TRRIYRPKSLTGAKDLTKNAEVVAGTGEQCLPFDEARCGDGGKAVEATLMSPKGMAVDKNGLIYFVDGTM

IRKVDQNGIISTLLGSNDLTSARPLTCDTSMHISQVRLEWPTDLAINPMDNSIYVLDNNVVLQITENRQV

RIAAGRPMHCQVPGVEYPVGKHAVQTTLESATAIAVSYSGVLYITETDEKKINRIRQVTTDGEISLVAGI

PSECDCKNDANCDCYQSGDGYAKDAKLSAPSSLAASPDGTLYIADLGNIRIRAVSKNKPLLNSMNFYEVA

SPTDQELYIFDINGTHQYTVSLVTGDYLYNFSYSNDNDITAVTDSNGNTLRIRRDPNRMPVRVVSPDNQV

IWLTIGTNGCLKGMTAQGLELVLFTYHGNSGLLATKSDETGWTTFFDYDSEGRLTNVTFPTGVVTNLHGD

MDKAITVDIESSSREEDVSITSNLSSIDSFYTMVQDQLRNSYQIGYDGSLRIIYASGLDSHYQTEPHVLA

GTANPTVAKRNMTLPGENGQNLVEWRFRKEQAQGKVNVFGRKLRVNGRNLLSVDFDRTTKTEKIYDDHRK

FLLRIAYDTSGHPTLWLPSSKLMAVNVTYSSTGQIASIQRGTTSEKVDYDGQGRIVSRVFADGKTWSYTY

LEKSMVLLLHSQRQYIFEYDMWDRLSAITMPSVARHTMQTIRSIGYYRNIYNPPESNASIITDYNEEGLL

LQTAFLGTSRRVLFKYRRQTRLSEILYDSTRVSFTYDETAGVLKTVNLQSDGFICTIRYRQIGPLIDRQI

FRFSEDGMVNARFDYSYDNSFRVTSMQGVINETPLPIDLYQFDDISGKVEQFGKFGVIYYDINQIISTAV

MTYTKHFDAHGRIKEIQYEIFRSLMYWITIQYDNMGRVTKREIKIGPFANTTKYAYEYDVDGQLQTVYLN

EKIMWRYNYDLNGNLHLLNPSNSARLTPLRYDLRDRITRLGDVQYRLDEDGFLRQRGTEIFEYSSKGLLT

RVYSKGSGWTVIYRYDGLGRRVSSKTSLGQHLQFFYADLTYPTRITHVYNHSSSEITSLYYDLQGHLFAM

EISSGDEFYIASDNTGTPLAVFSSNGLMLKQIQYTAYGEIYFDSNIDFQLVIGFHGGLYDPLTKLIHFGE

RDYDILAGRWTTPDIEIWKRIGKDPAPFNLYMFRNNNPASKIHDVKDYITDVNSWLVTFGFHLHNAIPGF

PVPKFDLTEPSYELVKSQQWDDIPPIFGVQQQVARQAKAFLSLGKMAEVQVSRRAGGAQSWLWFATVKS

LIGKGVMLAVSQGRVQTNVLNIANEDCIKVAAVLNNAFYLENLHFTIEGKDTHYFIKTTTPESDLGTLRL

TABLE 15B-continued

NOV15a protein sequence

TSGRKALENGINVTVSQSTTVVNGRTRRFADVEMQFGALALHVRYGMTLDEEKARILEQARQRALARAWA

REQQRVRDGEEGARLWTEGEKRQLLSAGKVQGYDGYYVLSVEQYPELADSANNIQFLRQSEIGRR

The full amino acid sequence of the protein of the invention was found to have 2663 of 2725 amino acid residues (97%) identical to, and 2696 of 2725 amino acid residues (98%) similar to, the 2715 amino acid residue ptnr:SPTREMBL-ACC:Q9WTS6 protein from *Mus musculus* (Mouse) (TEN-M3).

The TEN-M3 disclosed in this invention is expressed in at least the following tissues: Brain, Cerebellum, Colon, Coronary Artery, Dermis, Heart, Hippocampus, Kidney, Lung, Lymph node, Mammary gland/Breast, Ovary, Parathyroid Gland, Pineal Gland, Placenta, Prostate, Smooth Muscle, Testis, Uterus. This information was derived by determining the tissue sources of the sequences that were included in the invention including but not limited to SeqCalling sources, Public EST sources, Literature sources, and/or RACE sources. Taqman expression analysis reveals that The TEN-M3 disclosed in this invention is expressed by several brain regions and by brain and lung tumor derived cell lines in TaqMan panel 1 and by kidney and lung tumors in panel 2.

The nucleic acids and proteins of the invention are useful in potential diagnostic and therapeutic applications implicated in various diseases and disorders described below and/or other pathologies. For example, the compositions of the present invention will have efficacy for treatment of patients suffering from cancer preferably in kidney and lung tumors The Potential Role(s) of TEN-M3-like protein and nucleic acid disclosed herein in Tumorgenesis is likely to be related to cell migration and invasion conferring higher metastatic potential. Therapeutic targeting of of TEN-M3-like protein and nucleic acid disclosed herein with a monoclonal antibody is anticipated to limit or block the extent of tumor cell migration and invasion and tumor metastasis, preferably in melanomas tumors.

NOV15b

A disclosed NOV15b nucleic acid of 8645 nucleotides (also referred to as CG55069-02) (SEQ ID NO:37) encoding a novel TEN-M3-like protein is shown in Table 15C. An open reading frame was identified beginning with an ATG initiation codon at nucleotides 151–153 and ending with a TAA codon at nucleotides 8314–8316. Putative untranslated regions upstream from the initiation codon and downstream from the termination codon are underlined and the start and stop codons are in bold in Table 15C.

TABLE 15C

NOV15b nucleotide sequence

TTTGGCCTCGGGCCAGAATTCGGCACGAGGGGTCTGGAGCTTGGAGGAGAAGTCTGAACT (SEQ ID NO:37)

AAGGATAAACTAAAGAGAGGCCAATGAGACTTGAACCCTGAGCCTAAGTTGTCACCAGCA

GGACTGATGTGCACACAGAAGGAATGAAGTATGGATGTGAAAGAACGCAGGCCTTACTGC

TCCCTGACCAAGAGCAGACGAGAGAAGGAACGGCGCTACACAAATTCCTCCGCAGACAAT

GAGGAGTGCCGGGTACCCACACAGAAGTCCTACAGTTCCAGCGAGACATTGAAAGCTTTT

GATCATGATTCCTCGCGGCTGCTTTACGGCAACAGAGTGAAGGATTTGGTTCACAGAGAA

GCAGACGAGTTCACTAGACAAGGACAGAATTTTACCCTAAGGCAGTTAGGAGTTTGTGAA

CCAGCAACTCGAAGAGGACTGGCATTTTGTGCGGAAATGGGGCTCCCTCACAGAGGTTAC

TCTATCAGTGCAGGGTCAGATGCTGATACTGAAAATGAAGCAGTGATGTCCCCAGAGCAT

GCCATGAGACTTTGGGGCAGGGGGTCAAATCAGGCCGCAGCTCCTGCCTGTCAAGTCGG

TCCAACTCAGCCCTCACCCTGACAGATACGGAGCACGAAAACAAGTCCGACAGTGAGAAT

GAGCAACCTGCAAGCAATCAAGGCCAGTCTACCCTGCAGCCCTTGCCGCCTTCCCATAAG

CAGCACTCTGCACAGCATCATCCATCCATCACTTCTCTCAACAGAAACTCCCTGACCAAT

AGAAGGAACCAGAGTCCGGCCCCGCCGGCTGCTTTGCCCGCCGAGCTGCAAACCACACCC

GAGTCCGTCCAGCTGCAGGACAGCTGGGTCCTTGGCAGTAATGTACCACTGGAAAGCAGG

CATTTCCTATTCAAAACAGGAACAGGTACAACGCCACTGTTCAGTACTGCAACCCCAGGA

TACACAATGGCATCTGGCTCTGTTTATTCACCACCTACTCGGCCACTACCTAGAAACACC

CTATCAAGAAGTGCTTTTAAATTCAAGAAGTCTTCAAAGTACTGTAGCTGGAAATGCACT

TABLE 15C-continued

NOV15b nucleotide sequence

```
GCACTGTGTGCCGTAGGGGTCTCGGTGCTCCTGGCAATACTCCTGTCTTATTTTATAGCA
ATGCATCTCTTTGGCCTCAACTGGCAGCTACAGCAGACTGAAAATGACACATTTGAGAAT
GGAAAAGTGAATTCTGATACCATGCCAACAAACACTGTGTCATTACCTTCTGGAGACAAT
GGAAAATTAGGTGGATTTACGCAAGAAAATAACACCATAGATTCCGGAGAACTTGATATT
GGCCGAAGAGCAATTCAAGAGATTCCTCCCGGGATCTTCTGGAGATCACAGCTCTTCATT
GATCAGCCACAGTTTCTTAAATTCAATATCTCTCTTCAGAAGGATGCATTGATTGGAGTA
TATGGCCGGAAAGGCTTACCGCCTTCCCATACTCAGTATGACTTCGTGGAGCTCCTGGAT
GGCAGCAGGCTGATTGCCAGAGAGCAGCGGAGCCTGCTTGAGACGGAGAGAGCCGGGCGG
CAGGCGAGATCCGTCAGCCTTCATGAGGCCGGCTTTATCCAGTACTTGGATTCTGGAATC
TGGCATCTGGCTTTTTATAATGATGGGAAAAATGCAGAGCAGGTGTCTTTTAATACCATT
GTTATAGAGTCTGTGGTGGAATGTCCCCGAAATTGCCATGGAAATGGAGAATGCGTTTCT
GGAACTTGCCATTGTTTTCCAGGATTTCTGGGTCCGGATTGTTCAAGAGCCGCCTGTCCA
GTGTTATGTAGTGGCAACGGGCAGTACTCCAAGGGCCGCTGCCTGTGTTTCAGCGGCTGG
AAGGGCACCGAGTGTGATGTGCCGACTACCCAGTGTATTGACCCACAGTGTGGGGGTCGT
GGGATTTGTATCATGGGCTCCTGTGCTTGCAGCTCAGGATACAAAGGAGAAAGTTGTGAA
GAAGCTGACTGTATAGACCCTGGGTGTTCTAATCATGGTGTGTGTATCCACGGGGAATGT
CACTGCAGTCCAGGATGGGGAGGTAGCAATTGTGAAATACTGAAGACCATGTGTCCAGAC
CAGTGCTCCGGCCACGGAACGTATCTTCAAGAAAGTGGCTCCTGCACGTGTGACCCTAAC
TGGACTGGCCCAGACTGCTCAAACGAAATATGTTCTGTGGACTGTGGCTCACACGGCGTT
TGCATGGGGGGACGTGTCGCTGTGAAGAAGGCTGGACGGGCCCAGCCTGTAATCAGAGA
GCCTGCCACCCCGCTGTGCCGAGCACGGGACCTGCAAGGATGGCAAGTGTGAATGCAGC
CAGGGCTGGAATGGAGAGCACTGCACTATCGCTCACTATTTGGATAAGATAGTTAAAGAC
AAGATAGGATATAAAGAGGGTTGTCCTGGTCTGTGCAACAGCAATGGAAGATGTACCCTG
GACCAAAATGGCGGACATTGTGTGTGCCAGCCTGGATGGAGAGGAGCAGGCTGTGACGTA
GCCATGGAGACTCTTTGCACAGATAGCAAGGACAATGAAGGGGATGGACTCATTGACTGC
ATGGATCCCGATTGCTGCCTACAGAGTTCCTGCCAGAATCAGCCCTATTGTCGGGGACTG
CCGGATCCTCAGGACATCATTAGCCAAAGCCTTCAATCGCCTTCTCAGCAAGCTGCCAAA
TCCTTTTATGATCGAATCAGTTTCCTTATAGGATCTGATAGCACCCATGTTATACCTGGA
GAAAGTCCTTTCAATAAGAGCCTTGCATCTGTCATCAGAGGCCAAGTACTGACTGCTGAT
GGAACTCCACTTATTGGAGTAAATGTCTCGTTTTTCCATTACCCAGAATATGGATATACT
ATTACCCGCCAGGACGGAATGTTTGACTTGGTGGCAAATGGTGGGCCTCTCTAACTTTG
GTATTTGAACGATCCCCATTCCTCACTCAGTATCATACTGTGTGGATTCCATGGAATGTC
TTTTATGTGATGGATACCCTAGTCATGGAGAAAGAAGAGAATGACATTCCCAGCTGTGAT
CTGAGTGGATTCGTGAGGCCAAATCCCATCATTGTGTCATCACCTTTATCCACCTTTTTC
AGATCTTCTCCTGAAGACAGTCCCATCATTCCCGAAACACAGGTACTCCACGAGGAAACT
ACAATTCCAGGAACAGATTTGAAACTCTCCTACTTGAGTTCCAGAGCTGCAGGGTATAAG
TCAGTTCTCAAGATCACCATGACCCAGTCTATTATTCCATTTAATTTAATGAAGGTTCAT
CTTATGGTAGCTGTAGTAGGAAGACTCTTCCAAAAGTGGTTTCCTGCCTCACCAAACTTG
GCCTATACTTTCATATGGGATAAAACAGATGCATATAATCAGAAAGTCTATGGTCTATCT
```

TABLE 15C-continued

NOV15b nucleotide sequence

```
GAAGCTGTTGTGTCAGTTGGATATGAGTATGAGTCGTGTTTGGACCTGACTCTGTGGGAA
AAGAGGACTGCCATTCTGCAGGGCTATGAATTGGATGCGTCCAACATGGGTGGCTGGACA
TTAGATAAACATCACGTGCTGGATGTACAGAACGGTATACTGTACAAGGGAAACGGGGAA
AACCAGTTCATCTCCCAGCAGCCTCCAGTCGTGAGTAGCATCATGGGCAATGGGCGAAGG
CGCAGCATTTCCTGCCCCAGTTGCAATGGTCAAGCTGATGGTAACAAGTTACTGGCCCCA
GTGGCGCTAGCTTGTGGGATCGATGGCAGTCTGTACGTAGGCGATTTCAACTACGTGCGG
CGGATATTCCCTTCTGGAAATGTAACAAGTGTCTTAGAACTAAGAAATAAAGATTTTAGA
CATAGCAGCAACCCAGCTCATAGATACTACCTTGCAACGGATCCAGTCACGGGAGATCTG
TACGTTTCTGACACAAACACCCGCAGAATTTATCGCCCAAAGTCACTTACGGGGCAAAA
GACTTGACTAAAAATGCAGAAGTCGTCGCAGGGACAGGGGAGCAATGCCTTCCGTTTGAC
GAGGCGAGATGTGGGGATGGAGGGAAGGCCGTGGAAGCCACACTCATGAGTCCCAAAGGA
ATGGCAGTTGATAAGAATGGATTAATCTACTTTGTTGATGGAACCATGATTAGGAAAGTT
GACCAAAATGGAATCATATCAACTCTTCTGGGCTCTAACGATTTGACTTCAGCCAGACCT
TTAACTTGTGACACCAGCATGCACATCAGCCAGGTACGTCTGGAATGGCCCACTGACCTA
GCCATTAACCCTATGGATAACTCCATTTATGTCCTGGATAATAATGTAGTTTTACAGATC
ACTGAAAATCGTCAAGTTCGCATTGCTGCTGGACGGCCCATGCACTGTCAGGTTCCCGGA
GTGGAATATCCTGTGGGAAGCACGCGGTGCAGACAACACTGGAATCAGCCACTGCCATT
GCTGTGTCCTACAGTGGGGTCCTGTACATTACTGAAACTGATGAGAAGAAAATTAACCGG
ATAAGGCAGGTCACAACAGATGGAGAAATCTCCTTAGTGGCCGGAATACCTTCAGAGTGT
GACTGCAAAAATGATGCCAACTGTGACTGTTACCAGAGTGGAGATGGCTACGCCAAGGAT
GCCAAACTCAGTGCCCCATCCTCCCTGGCTGCTTCTCCAGATGGTACACTGTATATTGCA
GATCTAGGGAATATCCGGATCCGGGCTGTGTCAAAGAATAAGCCTTTACTTAACTCTATG
AACTTCTATGAAGTTGCGTCTCCAACTGATCAAGAACTCTACATCTTTGACATCAATGGT
ACTCACCAATATACTGTAAGTTTAGTCACTGGTGATTACCTTTACAATTTTAGCTACAGC
AATGACAATGATATTACTGCTGTGACAGACAGCAATGGCAACACCCTTAGAATTAGACGG
GACCCAAATCGCATGCCAGTTCGAGTGGTGTCTCCTGATAACCAAGTGATATGGTTGACA
ATAGGAACAAATGGATGTTTGAAAGGCATGACTGCTCAAGGACTGGAATTAGTTTTGTTT
ACTTACCATGGCAATAGTGGCCTTTTAGCCACTAAAAGTGATGAAACTGGATGGACAACG
TTTTTTGACTATGACAGTGAAGGTCGTCTGACAAATGTTACGTTTCCAACTGGAGTGGTC
ACAAACCTGCATGGGGACATGGACAAGGCTATCACAGTGGACATTGAGTCATCTAGCCGA
GAAGAAGATGTCAGCATCACTTCAAATCTGTCCTCGATCGATTCTTTCTACACCATGGTT
CAAGATCAGTTAAGAAACAGCTACCAGATTGGTTATGACGGCTCCCTCAGAATTATCTAC
GCCAGTGGCCTGGACTCACACTACCAAACAGAGCCGCACGTTCTGGCTGGCACCGCTAAT
CCGACGGTTGCCAAAAGAAACATGACTTTGCCTGGCGAGAACGGTCAAAACTTGGTGGAA
TGGAGATTCCGAAAAGAGCAAGCCCAAGGGAAAGTCAATGTCTTTGGCCGCAAGCTCAGG
GTTAATGGCAGAAACCTCCTTTCAGTTGACTTTGATCGAACAACAAAGACAGAAAAGATC
TATGACGACCACCGTAAATTTCTACTGAGGATCGCCTACGACACGTCTGGGCACCCGACT
CTCTGGCTGCCAAGCAGCAAGCTGATGGCCGTCAATGTCACCTATTCATCCACAGGTCAA
```

TABLE 15C-continued

NOV15b nucleotide sequence

ATTGCCAGCATCCAGCGAGGCACCACTAGCGAGAAAGTAGATTATGACGGACAGGGGAGG
ATCGTGTCTCGGGTCTTTGCTGATGGTAAAACATGGAGTTACACATATTTAGAAAAGTCC
ATGGTTCTTCTGCTTCATAGCCAGCGGCAGTACATCTTCGAATACGATATGTGGGACCGC
CTGTCTGCCATCACCATGCCCAGTGTGGCTCGCCACACCATGCAGACCATCCGATCCATT
GGCTACTACCGCAACATATACAACCCCCCGGAAAGCAACGCCTCCATCATCACGGACTAC
AACGAGGAAGGGCTGCTTCTACAAACAGCTTTCTTGGGTACAAGTCGGAGGGTCTTATTC
AAATACAGAAGGCAGACTAGGCTCTCAGAAATTTTATATGATAGCACAAGAGTCAGTTTT
ACCTATGATGAAACAGCAGGAGTCCTAAAGACAGTAAACCTCCAGAGTGATGGTTTTATT
TGCACCATTAGATACAGGCAAATTGGTCCCCTGATTGACAGGCAGATTTTCCGCTTTAGT
GAAGATGGGATGGTAAATGCAAGATTTGACTATAGCTATGACAACAGCTTTCGAGTGACC
AGCATGCAGGGTGTGATCAATGAAACGCCACTGCCTATTGATCTGTATCAGTTTGATGAC
ATTTCTGGCAAAGTTGAGCAGTTTGGAAAGTTTGGAGTTATATATTATGATATTAACCAG
ATCATTTCTACAGCTGTAATGACCTATACGAAGCACTTTGATGCTCATGGCCGTATCAAG
GAGATTCAATATGAGATATTCAGGTCGCTCATGTACTGGATTACAATTCAGTATGATAAC
ATGGGTCGGGTAACCAAGAGAGATTAAAATAGGGCCCTTTGCCAACACCACCAAATAT
GCTTATGAATATGATGTTGATGGACAGCTCCAAACAGTTTACCTCAATGAAAAGATAATG
TGGCGGTACAACTACGATCTGAATGGAAACCTCCATTTACTGAACCCAAGTAACAGTGCG
CGTCTGACACCCCTTCGCTATGACCTGCGAGACAGAATCACTCGACTGGGTGATGTTCAA
TATCGGTTGGATGAAGATGGTTTCCTACGTCAAAGGGGCACGGAAATCTTTGAATATAGC
TCCAAGGGGCTTCTAACTCGAGTTTACAGTAAAGGCAGTGGCTGGACAGTGATCTACCGT
TATGACGGCCTGGGAAGGCGTGTTTCTAGCAAAACCAGTCTAGGACAGCACCTGCAGTTT
TTTTATGCTGACTTAACTTATCCCACTAGGATTACTCATGTCTACAACCATTCGAGTTCA
GAAATTACCTCCCTGTATTATGATCTCCAAGGACATCTTTTTGCCATGGAAATCAGCAGT
GGGGATGAATTCTATATTGCATCGGATAACACAGGGACACCACTGGCTGTGTTCAGTAGC
AATGGGCTTATGCTGAAACAGATTCAGTACACTGCATATGGGGAAATCTATTTTGACTCT
AATATTGACTTTCAACTGGTAATTGGATTTCATGGTGGCCTGTATGACCCACTCACCAAA
TTAATCCACTTTGGAGAAAGAGATTATGACATTTTGGCAGGACGGTGGACAACACCTGAC
ATAGAAATCTGGAAAAGAATTGGGAAGGACCCAGCTCCTTTTAACTTGTACATGTTTAGG
AATAACAACCCTGCAAGCAAAATCCATGACGTGAAAGATTACATCACAGATGTTAACAGC
TGGCTGGTGACATTTGGTTTCCATCTGCACAATGCTATTCCTGGATTCCCTGTTCCCAAA
TTTGATTTAACAGAACCTTCTTACGAACTTGTGAAGAGTCAGCAGTGGGATGATATACCG
CCCATCTTCGGAGTCCAGCAGCAAGTGGCGCGGCAGGCCAAGGCCTTCCTGTCGCTGGGG
AAGATGGCCGAGGTGCAGGTGAGCCGGCGCCGGGCCGGCGGCGCGCAGTCCTGGCTGTGG
TTCGCCACGGTCAAGTCGCTGATCGGCAAGGGCGTCATGCTGGCCGTCAGCCAGGGCCGC
GTGCAGACCAACGTGCTCAACATCGCCAACGAGGACTGCATCAAGGTGGCGGCCGTGCTC
AACAACGCCTTCTACCTGGAGAACCTGCACTTCACCATCGAGGGCAAGGACACGCACTAC
TTCATCAAGACCACCACGCCCGAGAGCGACCTGGGCACGCTGCGGTTGACCAGCGGCCGC
AAGGCGCTGGAGAACGGCATCAACGTGACGGTGTCGCAGTCCACCACGGTGGTGAACGGC
AGGACGCGCAGGTTCGCGGACGTGGAGATGCAGTTCGGCGCGCTGGCGCTGCACGTGCGC

TABLE 15C-continued

NOV15b nucleotide sequence

TACGGCATGACCCTGGACGAGGAGAAGGCGCGCATCCTGGAGCAGGCGCGGCAGCGCGCG

CTCGCCCGGGCCTGGGCGCGCGAGCAGCAGCGCGTGCGCGACGGCGAGGAGGGCGCGCGC

CTCTGGACGGAGGGCGAGAAGCGGCAGCTGCTGAGCGCCGGCAAGGTGCAGGGCTACGAC

GGGTACTACGTACTCTCGGTGGAGCAGTACCCCGAGCTGGCCGACAGCGCCAACAACATC

CAGTTCCTGCGGCAGAGCGAGATCGGCAGGAGGTAACGCCCGGGCCGCGCCCGCCGAGCC

GCTCACGCCCTGCCCACATTGTCCTGTGGCACAACCCGAGTGGGACTCTCCAACGCCAA

GAGCCTTCCTCCCGGGGAATGAGACTGCTGTTACGACCCACACCCACCGCGAAAACA

AGGACCGCTTTTTTCCGAATGACCTTAAAGGTGATCGGCTTTAACGAATATGTTTACATA

TGCATAGCGCTGCACTCAGTCGGACTGAACGTAGCCAGAGGAAAAAAAAATCATCAAGGA

CAAAGGCCTCGACCTGTTGCGCTGGGCCGTCTGTTCCTTCTAGGCACTGTATTTAACTAA

CTTTA

The TEN-M3 NOV15b disclosed in this invention maps to chromosome 4.

In a search of sequence databases, it was found, for example, that the nucleic acid sequence of this invention has 5395 of 6175 bases (87%) identical to a gb:GENBANK-ID:AB025412|acc:AB025412.1 mRNA from *Mus musculus* (*Mus musculus* mRNA for Ten-m3, complete cds).

A disclosed NOV15b polypeptide (SEQ ID NO:38) encoded by SEQ ID NO:37 has 2721 amino acid residues and is presented in Table 15D using the one-letter code. Although PSORT suggests that the TEN-M3-like protein may be localized nucleus, the protein of CuraGen Acc. No. CG55069-02 predicted here is similar to the tenascins family, some members of which are secreted or membrane protein. Therefore it is likely that this novel TEN-M3-like protein also shows similar localization. The hydropathy plot supports this conclusion. NOV15b seems to be a Type II (Ncyt Cexo) membrane protein with an INTEGRAL Likelihood of −9.39 for Transmembrane 309–325 (305–337). The SignalP, Psort and/or Hydropathy results predict that NOV15b has no signal peptide and is likely to be localized in the nucleus with a certainty of 0.8000. In an alternative embodiment, NOV15b is likely to be localized to the plasma membrane with a certainty of 0.7900, or to the microbody (peroxisome) with a certainty of 0.3453, or to the Golgi body with a certainty of 0.3000.

TABLE 15D

NOV15b protein sequence

MDVKERRPYCSLTKSRREKERRYTNSSADNEECRVPTQKSYSSSETLKAFDHDSSRLLYG (SEQ ID NO:38)

NRVKDLVHREADEFTRQGQNFTLRQLGVCEPATRRGLAFCAEMGLPHRGYSISAGSDADT

ENEAVMSPEHAMRLWGRGVKSGRSSCLSSRSNSALTLTDTEHENKSDSENEQPASNQGQS

TLQPLPPSHKQHSAQHHPSITSLNRNSLTNRRNQSPAPPAALPAELQTTPESVQLQDSWV

LGSNVPLESRHFLFKTGTGTTPLFSTATPGYTMASGSVYSPPTRPLPRNTLSRSAFKFKK

SSKYCSWKCTALCAVGVSVLLAILLSYFIAMHLFGLNWQLQQTENDTFENGKVNSDTMPT

NTVSLPSGDNGKLGGFTQENNTIDSGELDIGRRAIQEIPPGIFWRSQLFIDQPQFLKFNI

SLQKDALIGVYGRKGLPPSHTQYDFVELLDGSRLIAREQRSLLETERAGRQARSVSLHEA

GFIQYLDSGIWHLAFYNDGKNAEQVSFNTIVIESVVECPRNCHGNGECVSGTCHCFPGFL

GPDCSRAACPVLCSGNGQYSKGRCLCFSGWKGTECDVPTTQCIDPQCGGRGICIMGSCAC

SSGYKGESCEEADCIDPGCSNHGVCIHGECHCSPGWGGSNCEILKTMCPDQCSGHGTYLQ

ESGSCTCDPNWTGPDCSNEICSVDCGSHGVCMGGTCRCEEGWTGPACNQRACHPRCAEHG

TCKDGKCECSQGWNGEHCTIAHYLDKIVKDKIGYKEGCPGLCNSNGRCTLDQNGGHCVCQ

PGWRGAGCDVAMETLCTDSKDNEGDGLIDCMDPDCCLQSSCQNQPYCRGLPDPQDIISQS

LQSPSQQAAKSFYDRISFLIGSDSTHVIPGESPFNKSLASVIRGQVLTADGTPLIGVNVS

TABLE 15D-continued

NOV15b protein sequence

```
FFHYPEYGYTITRQDGMFDLVANGGASLTLVFERSPFLTQYHTVWIPWNVFYVMDTLVME
KEENDIPSCDLSGFVRPNPIIVSSPLSTFFRSSPEDSPIIPETQVLHEETTIPGTDLKLS
YLSSRAAGYKSVLKITMTQSIIPFNLMKVHLMVAVVGRLFQKWFPASPNLAYTFIWDKTD
AYNQKVYGLSEAVVSVGYEYESCLDLTLWEKRTAILQGYELDASNMGGWTLDKHHVLDVQ
NGILYKGNGENQFISQQPPVVSSIMGNGRRRSISCPSCNGQADGNKLLAPVALACGIDGS
LYVGDFNYVRRIFPSGNVTSVLELRNKDFRHSSNPAHRYYLATDPVTGDLYVSDTNTRRI
YRPKSLTGAKDLTKNAEVVAGTGEQCLPFDEARCGDGGKAVEATLMSPKGMAVDKNGLIY
FVDGTMIRKVDQNGIISTLLGSNDLTSARPLTCDTSMHISQVRLEWPTDLAINPMDNSIY
VLDNNVVLQITENRQVRIAAGRPMHCQVPGVEYPVGKHAVQTTLESATAIAVSYSGVLYI
TETDEKKINRIRQVTTDGEISLVAGIPSECDCKNDANCDCYQSGDGYAKDAKLSAPSSLA
ASPDGTLYIADLGNIRIRAVSKNKPLLNSMNFYEVASPTDQELYIFDINGTHQYTVSLVT
GDYLYNFSYSNDNDITAVTDSNGNTLRIRRDPNRMPVRVVSPDNQVIWLTIGTNGCLKGM
TAQGLELVLFTYHGNSGLLATKSDETGWTTFFDYDSEGRLTNVTFPTGVVTNLHGDMDKA
ITVDIESSSREEDVSITSNLSSIDSFYTMVQDQLRNSYQIGYDGSLRIIYASGLDSHYQT
EPHVLAGTANPTVAKRNMTLPGENGQNLVEWRFRKEQAQGKVNVFGRKLRVNGRNLLSVD
FDRTTKTEKIYDDHRKFLLRIAYDTSGHPTLWLPSSKLMAVNVTYSSTGQIASIQRGTTS
EKVDYDGQGRIVSRVFADGKTWSYTYLEKSMVLLLHSQRQYIFEYDMWDRLSAITMPSVA
RHTMQTIRSIGYYRNIYNPPESNASIITDYNEEGLLLQTAFLGTSRRVLFKYRRQTRLSE
ILYDSTRVSFTYDETAGVLKTVNLQSDGFICTIRYRQIGPLIDRQIFRFSEDGMVNARFD
YSYDNSFRVTSMQGVINETPLPIDLYQFDDISGKVEQFGKFGVIYYDINQIISTAVMTYT
KHFDAHGRIKEIQYEIFRSLMYWITIQYDNMGRVTKREIKIGPFANTTKYAYEYDVDGQL
QTVYLNEKIMWRYNYDLNGNLHLLNPSNSARLTPLRYDLRDRITRLGDVQYRLDEDGFLR
QRGTEIFEYSSKGLLTRVYSKGSGWTVIYRYDGLGRRVSSKTSLGQHLQFFYADLTYPTR
ITHVYNHSSSEITSLYYDLQGHLFAMEISSGDEFYIASDNTGTPLAVFSSNGLMLKQIQY
TAYGEIYFDSNIDFQLVIGFHGGLYDPLTKLIHFGERDYDILAGRWTTPDIEIWKRIGKD
PAPFNLYMFRNNNPASKIHDVKDYITDVNSWLVTFGFHLHNAIPGFPVPKFDLTEPSYEL
VKSQQWDDIPPIFGVQQQVARQAKAFLSLGKMAEVQVSRRRAGGAQSWLWFATVKSLIGK
GVMLAVSQGRVQTNVLNIANEDCIKVAAVLNNAFYLENLHFTIEGKDTHYFIKTTTPESD
LGTLRLTSGRKALENGINVTVSQSTTVVNGRTRRFADVEMQFGALALHVRYGMTLDEEKA
RILEQARQRALARAWAREQQRVRDGEEGARLWTEGEKRQLLSAGKVQGYDGYYVLSVEQY
PELADSANNIQFLRQSEIGRR
```

The full amino acid sequence of the protein of the invention was found to have 2664 of 2721 amino acid residues (97%) identical to, and 2697 of 2721 amino acid residues (99%) similar to, the 2715 amino acid residue ptnr:SPTREMBL-ACC:Q9WTS6 protein from *Mus musculus* (Mouse) (TEN-M3).

The TEN-M3-like gene disclosed in this invention is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea and uterus.

The nucleic acids and proteins of the invention have applications in the diagnosis and/or treatment of various diseases and disorders. For example, the compositions of the present invention will have efficacy for the treatment of patients suffering from: CNS disorders, neuronal developmental disorders, heart diseases such as stroke, myocardial infarction, ischemia, cancer, localized and systemic scleroderma, pleural inflammatory and fibrotic diseases as well as other diseases, disorders and conditions.

NOV15c

A disclosed NOV15c nucleic acid of 8473 nucleotides (also referred to as CG55069-03) (SEQ ID NO:39) encoding a novel TEN-M3-like protein is shown in Table 15E. An open reading frame was identified beginning with an ATG initiation codon at nucleotides 258–260 and ending with a TAA codon at nucleotides 8142–8144. Putative untranslated regions upstream from the initiation codon and downstream from the termination codon are underlined and the start and stop codons are in bold in Table 15E.

TABLE 15E

| NOV15c nucleotide sequence |
|---|
| <u>TTGACAGAAAAAGGCAGTAAACGGGGAATCTCTTTTTTTGAATAAAGAAGAAGAAGAAAT</u> (SEQ ID NO:39) |
| <u>AAAGTACCTGTCATCTTGACAAGTGGCGGAGCGGAGGAGTCAAGGATTATAAATGATCAC</u> |
| <u>AGCCAGGTCCAGCTCGCCCCGTGATTGGGCTCTCCCGCGATCTGCACCGGGGGAAGCGCA</u> |
| <u>TGAGAGGCCAATGAGACTTGAACCCTGAGCCTAAGTTGTCACCAGCAGGACTGATGTGCA</u> |
| <u>CACAGAAGGAATGAAGT</u>ATGGATGTGAAAGAACGCAGGCCTTACTGCTCCCTGACCAAGA |
| GCAGACGAGAGAAGGAACGGCGCTACACAAATTCCTCCGCAGACAATGAGGAGTGCCGGG |
| TACCCACACAGAAGTCCTACAGTTCCAGCGAGACATTGAAAGCTTTTGATCATGATTCCT |
| CGCGGCTGCTTTACGGCAACAGAGTGAAGGATTTGGTTCACAGAGAAGCAGACGAGTTCA |
| CTAGACAAGAGCAACCTGCAAGCAATCAAGGCCAGTCTACCCTGCAGCCCTTGCCGCCTT |
| CCCATAAGCAGCACTCTGCACAGCATCATCCATCCATCACTTCTCTCAACAGAAACTCCC |
| TGACCAATAGAAGGAACCAGAGTCCGGCCCCGCCGGCTGCTTTGCCCGCCGAGCTGCAAA |
| CCACACCCGAGTCCGTCCAGCTGCAGGACAGCTGGGTCCTTGGCAGTAATGTACCACTGG |
| AAAGCAGGCATTTCCTATTCAAAACAGGAACAGGTACAACGCCACTGTTCAGTACTGCAA |
| CCCCAGGATACACAATGGCATCTGGCTCTGTTTATTCACCACCTACTCGGCCACTACCTA |
| GAAACACCCTATCAAGAAGTGCTTTTAAATTCAAGAAGTCTTCAAAGTACTGTAGCTGGA |
| AATGCACTGCACTGTGTGCCGTAGGGGTCTCGGTGCTCCTGGCAATACTCCTGTCTTATT |
| TTATAGCAATGCATCTCTTTGGCCTCAACTGGCAGCTACAGCAGACTGAAAATGACACAT |
| TTGAGAATGGAAAAGTGAATTCTGATACCATGCCAACAAACACTGTGTCATTACCTTCTG |
| GAGACAATGGAAAATTAGGTGGATTTACGCAAGAAAATAACACCATAGATTCCGGAGAAC |
| TTGATATTGGCCGAAGAGCAATTCAAGAGATTCCTCCCGGGATCTTCTGGAGATCACAGC |
| TCTTCATTGATCAGCCACAGTTTCTTAAATTCAATATCTCTCTTCAGAAGGATGCATTGA |
| TTGGAGTATATGGCCGGAAAGGCTTACCGCCTTCCCATACTCAGTATGACTTCGTGGAGC |
| TCCTGGATGGCAGCAGGCTGATTGCCAGAGAGCAGCGGAGCCTGCTTGAGACGGAGAGAG |
| CCGGGCGGCAGGCGAGATCCGTCAGCCTTCATGAGGCCGGCTTTATCCAGTACTTGGATT |
| CTGGAATCTGGCATCTGGCTTTTTATAATGATGGGAAAAATGCAGAGCAGGTGTCTTTTA |
| ATACCATTGTTATAGAGTCTGTGGTGGAATGTCCCCGAAATTGCCATGGAAATGGAGAAT |
| GCGTTTCTGGAACTTGCCATTGTTTTCCAGGATTTCTGGGTCCGGATTGTTCAAGAGCCG |
| CCTGTCCAGTGTTATGTAGTGGCAACGGGCAGTACTCCAAGGGCCGCTGCCTGTGTTTCA |
| GCGGCTGGAAGGGCACCGAGTGTGATGTGCCGACTACCCAGTGTATTGACCCACAGTGTG |
| GGGGTCGTGGGATTTGTATCATGGGCTCTTGTGCTTGCAACTCAGGATACAAAGGAAAAA |
| GTTGTGAAGAAGCTGACTGTATAGACCCTGGGTGTTCTAATCATGGTGTGTGTATCCACG |
| GGGAATGTCACTGCAGTCCAGGATGGGGAGGTAGCAATTGTGAAATACTGAAGACCATGT |
| GTCCAGACCAGTGCTCCGGCCACGGAACGTATCTTCAAGAAAGTGGCTCCTGCACGTGTG |
| ACCCTAACTGGACTGGCCCAGACTGCTCAAACGAAATATGTTCTGTGGACTGTGGCTCAC |

TABLE 15E-continued

NOV15c nucleotide sequence

ACGGCGTTTGCATGGGGGGACGTGTCGCTGTGAAGAAGGCTGGACGGGCCCAGCCTGTA
ATCAGAGAGCCTGCCACCCCCGCTGTGCCGAGCACGGGACCTGCAAGGATGGCAAGTGTG
AATGCAGCCAGGGCTGGAATGGAGAGCACTGCACTATCGCTCACTATTTGGATAAGATAG
TTAAAGACAAGATAGGATATAAAGAGGGTTGTCCTGGTCTGTGCAACAGCAATGGAAGAT
GTACCCTGGACCAAAATGGCGGACATTGTGTGTGCCAGCCTGGATGGAGAGGAGCAGGCT
GTGACGTAGCCATGGAGACTCTTTGCACAGATAGCAAGGACAATGAAGGGGATGGACTCA
TTGACTGCATGGATCCCGATTGCTGCCTACAGAGTTCCTGCCAGAATCAGCCCTATTGTC
GGGGACTGCCGGATCCTCAGGACATCATTAGCCAAAGCCTTCAATCGCCTTCTCAGCAAG
CTGCCAAATCCTTTTATGATCGAATCAGTTTCCTTATAGGATCTGATAGCACCCATGTTA
TACCTGGAGAAAGTCCTTTCAATAAGAGCCTTGCATCTGTCATCAGAGGCCAAGTACTGA
CTGCTGATGGAACTCCACTTATTGGAGTAAATGTCTCGTTTTTCCATTACCCAGAATATG
GATATACTATTACCCGCCAGGACGGAATGTTTGACTTGGTGGCAAATGGTGGGCCTCTC
TAACTTTGGTATTTGAACGATCCCCATTCCTCACTCAGTATCATACTGTGTGGATTCCAT
GGAATGTCTTTTATGTGATGGATACCCTAGTCATGGAGAAAGAAGAGAATGACATTCCCA
GCTGTGATCTGAGTGGATTCGTGAGGCCAAATCCCATCATTGTGTCATCACCTTTATCCA
CCTTTTTCAGATCTTCTCCTGAAGACAGTCCCATCATTCCCGAAACACAGGTACTCCACG
AGGAAACTACAATTCCAGGAACAGATTTGAAACTCTCCTACTTGAGTTCCAGAGCTGCAG
GGTATAAGTCAGTTCTCAAGATCACCATGACCCAGTCTATTATTCCATTTAATTTAATGA
AGGTTCATCTTATGGTAGCTGTAGTAGGAAGACTCTTCCAAAAGTGGTTTCCTGCCTCAC
CAAACTTGGCCTATACTTTCATATGGGATAAAACAGATGCATATAATCAGAAAGTCTATG
GTCTATCTGAAGCTGTTGTGTCAGTTGGATATGAGTATGAGTCGTGTTTGGACCTGACTC
TGTGGGAAAAGAGGACTGCCATTCTGCAGGGCTATGAATTGGATGCGTCCAACATGGGTG
GCTGGACATTAGATAAACATCACGTGCTGGATGTACAGAACGGTATACTGTACAAGGGAA
ACGGGGAAAACCAGTTCATCTCCCAGCAGCCTCCAGTCGTGAGTAGCATCATGGGCAATG
GGCGAAGGCGCAGCATTTCCTGCCCCAGTTGCAATGGTCAAGCTGATGGTAACAAGTTAC
TGGCCCCAGTGGCGCTAGCTTGTGGGATCGATGGCAGTCTGTACGTAGGCGATTTCAACT
ACGTGCGGCGGATATTCCCTTCTGGAAATGTAACAAGTGTCTTAGAACTAAGAAATAAAG
ATTTTAGACATAGCAGCAACCCAGCTCATAGATACTACCTTGCAACGGATCCAGTCACGG
GAGATCTGTACGTTTCTGACACAAACACCCGCAGAATTTATCGCCCAAAGTCACTTACGG
GGGCAAAAGACTTGACTAAAAATGCAGAAGTCGTCGCAGGGACAGGGGAGCAATGCCTTC
CGTTTGACGAGGCGAGATGTGGGGATGGAGGGAAGGCCGTGGAAGCCACACTCATGAGTC
CCAAAGGAATGGCAGTTGATAAGAATGGATTAATCTACTTTGTTGATGGAACCATGATTA
GGAAAGTTGACCAAAATGGAATCATATCAACTCTTCTGGGCTCTAACGATTTGACTTCAG
CCAGACCTTTAACTTGTGACACCAGCATGCACATCAGCCAGGTACGTCTGGAATGCCCA
CTGACCTAGCCATTAACCCTATGGATAACTCCATTTATGTCCTGGATAATAATGTAGTTT
TACAGATCACTGAAAATCGTCAAGTTCGCATTGCTGCTGGACGGCCCATGCACTGTCAGG
TTCCCGGAGTGGAATATCCTGTGGGGAAGCACGCGGTGCAGACAACACTGGAATCAGCCA
CTGCCATTGCTGTGTCCTACAGTGGGGTCCTGTACATTACTGAAACTGATGAGAAGAAAA

TABLE 15E-continued

NOV15c nucleotide sequence

TTAACCGGATAAGGCAGGTCACAACAGATGGAGAAATCTCCTTAGTGGCCGGAATACCTT

CAGAGTGTGACTGCAAAAATGATGCCAACTGTGACTGTTACCAGAGTGGAGATGGCTACG

CCAAGGATGCCAAACTCAGTGCCCCATCCTCCCTGGCTGCTTCTCCAGATGGTACACTGT

ATATTGCAGATCTAGGGAATATCCGGATCCGGGCTGTGTCAAAGAATAAGCCTTTACTTA

ACTCTATGAACTTCTATGAAGTTGCGTCTCCAACTGATCAAGAACTCTACATCTTTGACA

TCAATGGTACTCACCAATATACTGTAAGTTTAGTCACTGGTGATTACCTTTACAATTTTA

GCTACAGCAATGACAATGATATTACTGCTGTGACAGACAGCAATGGCAACACCCTTAGAA

TTAGACGGGACCCAAATCGCATGCCAGTTCGAGTGGTGTCTCCTGATAACCAAGTGATAT

GGTTGACAATAGGAACAAATGGATGTTTGAAAGGCATGACTGCTCAAGGACTGGAATTAG

TTTTGTTTACTTACCATGGCAATAGTGGCCTTTTAGCCACTAAAAGTGATGAAACTGGAT

GGACAACGTTTTTTGACTATGACAGTGAAGGTCGTCTGACAAATGTTACGTTTCCAACTG

GAGTGGTCACAAACCTGCATGGGGACATGGACAAGGCTATCACAGTGGACATTGAGTCAT

CTAGCCGAGAAGAAGATGTCAGCATCACTTCAAATCTGTCCTCGATCGATTCTTTCTACA

CCATGGTTCAAGATCAGTTAAGAAACAGCTACCAGATTGGTTATGACGGCTCCCTCAGAA

TTATCTACGCCAGTGGCCTGGACTCACACTACCAAACAGAGCCGCACGTTCTGGCTGGCA

CCGCTAATCCGACGGTTGCCAAAAGAAACATGACTTTGCCTGGCGAGAACGGTCAAAACT

TGGTGGAATGGAGATTCCGAAAAGAGCAAGCCCAAGGGAAAGTCAATGTCTTTGGCCGCA

AGCTCAGGGTTAATGGCAGAAACCTCCTTTCAGTTGACTTTGATCGAACAACAAAGACAG

AAAAGATCTATGACGACCACCGTAAATTTCTACTGAGGATCGCCTACGACACGTCTGGGC

ACCCGACTCTCTGGCTGCCAAGCAGCAAGCTGATGGCCGTCAATGTCACCTATTCATCCA

CAGGTCAAATTGCCAGCATCCAGCGAGGCACCACTAGCGAGAAAGTAGATTATGACGGAC

AGGGGAGGATCGTGTCTCGGGTCTTTGCTGATGGTAAAACATGGAGTTACACATATTTAG

AAAAGTCCATGGTTCTTCTGCTTCATAGCCAGCGGCAGTACATCTTCGAATACGATATGT

GGGACCGCCTGTCTGCCATCACCATGCCCAGTGTGGCTCGCCACACCATGCAGACCATCC

GATCCATTGGCTACTACCGCAACATATACAACCCCCCGGAAAGCAACGCCTCCATCATCA

CGGACTACAACGAGGAAGGGCTGCTTCTACAAACAGCTTTCTTGGGTACAAGTCGGAGGG

TCTTATTCAAATACAGAAGGCAGACTAGGCTCTCAGAAATTTTATATGATAGCACAAGAG

TCAGTTTTACCTATGATGAAACAGCAGGAGTCCTAAAGACAGTAAACCTCCAGAGTGATG

GTTTTATTTGCACCATTAGATACAGGCAAATTGGTCCCCTGATTGACAGGCAGATTTTCC

GCTTTAGTGAAGATGGGATGGTAAATGCAAGATTTGACTATAGCTATGACAACAGCTTTC

GAGTGACCAGCATGCAGGGTGTGATCAATGAAACGCCACTGCCTATTGATCTGTATCAGT

TTGATGACATTTCTGGCAAAGTTGAGCAGTTTGGAAAGTTTGGAGTTATATATTATGATA

TTAACCAGATCATTTCTACAGCTGTAATGACCTATACGAAGCACTTTGATGCTCATGGCC

GTATCAAGGAGATTCAATATGAGATATTCAGGTCGCTCATGTACTGGATTACAATTCAGT

ATGATAACATGGGTCGGGTAACCAAGAGAGAGATTAAAATAGGGCCCTTTGCCAACACCA

CCAAATATGCTTATGAATATGATGTTGATGGACAGCTCCAAACAGTTTACCTCAATGAAA

AGATAATGTGGCGGTACAACTACGATCTGAATGGAAACCTCCATTTACTGAACCCAAGTA

ACAGTGCGCGTCTGACACCCCTTCGCTATGACCTGCGAGACAGAATCACTCGACTGGGTG

ATGTTCAATATCGGTTGGATGAAGATGGTTTCCTACGTCAAAGGGGCACGGAAATCTTTG

TABLE 15E-continued

NOV15c nucleotide sequence

AATATAGCTCCAAGGGGCTTCTAACTCGAGTTTACAGTAAAGGCAGTGGCTGGACAGTGA
TCTACCGTTATGACGGCCTGGGAAGGCGTGTTTCTAGCAAAACCAGTCTAGGACAGCACC
TGCAGTTTTTTTATGCTGACTTAACTTATCCCACTAGGATTACTCATGTCTACAACCATT
CGAGTTCAGAAATTACCTCCCTGTATTATGATCTCCAAGGACATCTTTTTGCCATGGAAA
TCAGCAGTGGGGATGAATTCTATATTGCATCGGATAACACAGGGACACCACTGGCTGTGT
TCAGTAGCAATGGGCTTATGCTGAAACAGATTCAGTACACTGCATATGGGGAAATCTATT
TTGACTCTAATATTGACTTTCAACTGGTAATTGGATTTCATGGTGGCCTGTATGACCCAC
TCACCAAATTAATCCACTTTGGAGAAAGAGATTATGACATTTTGGCAGGACGGTGGACAA
CACCTGACATAGAAATCTGGAAAAGAATTGGGAAGGACCCAGCTCCTTTTAACTTGTACA
TGTTTAGGAATAACAACCCTGCAAGCAAAATCCATGACGTGAAAGATTACATCACAGATG
TTAACAGCTGGCTGGTGACATTTGGTTTCCATCTGCACAATGCTATTCCTGGATTCCCTG
TTCCCAAATTTGATTTAACAGAACCTTCTTACGAACTTGTGAAGAGTCAGCAGTGGGATG
ATATACCGCCCATCTTCGGAGTCCAGCAGCAAGTGGCGCGGCAGGCCAAGGCCTTCCTGT
CGCTGGGGAAGATGGCCGAGGTGCAGGTGAGCCGGCGCCGGGCCGGCGGCGCGCAGTCCT
GGCTGTGGTTCGCCACGGTCAAGTCGCTGATCGGCAAGGGCGTCATGCTGGCCGTCAGCC
AGGGCCGCGTGCAGACCAACGTGCTCAACATCGCCAACGAGGACTGCATCAAGGTGGCGG
CCGTGCTCAACAACGCCTTCTACCTGGAGAACCTGCACTTCACCATCGAGGGCAAGGACA
CGCACTACTTCATCAAGACCACCACGCCCGAGAGCGACCTGGGCACGCTGCGGTTGACCA
GCGGCCGCAAGGCGCTGGAGAACGGCATCAACGTGACGGTGTCGCAGTCCACCACGGTGG
TGAACGGCAGGACGCGCAGGTTCGCGGACGTGGAGATGCAGTTCGGCGCGCTGGCGCTGC
ACGTGCGCTACGGCATGACCCTGGACGAGGAGAAGGCGCGCATCCTGGAGCAGGCGCGGC
AGCGCGCGCTCGCCCGGGCCTGGGCGCGCGAGCAGCAGCGCGTGCGCGACGGCGAGGAGG
GCGCGCGCCTCTGGACGGAGGGCGAGAAGCGGCAGCTGCTGAGCGCCGGCAAGGTGCAGG
GCTACGACGGGTACTACGTACTCTCGGTGGAGCAGTACCCCGAGCTGGCCGACAGCGCCA
ACAACATCCAGTTCCTGCGGCAGAGCGAGATCGGCAGGAGGTAACGCCCGGGCCGCGCCC
GCCGAGCCGCTCACGCCCTGCCCACATTGTCCTGTGGCACAACCCGAGTGGGACTCTCCA
ACGCCCAAGAGCCTTCCTCCCGGGGGAATGAGACTGCTGTTACGACCCACACCCACACCG
CGAAAACAAGGACCGCTTTTTTCCGAATGACCTTAAAGGTGATCGGCTTTAACGAATATG
TTTACATATGCATAGCGCTGCACTCAGTCGGACTGAACGTAGCCAGAGGAAAAAAAAATC
ATCAAGGACAAAGGCCTCGACCTGTTGCGCTGGGCCGTCTGTTCCTTCTAGGCACTGTAT
TTAACTAACTTTA

The TEN-M3 NOV15c disclosed in this invention maps to chromosome 4.

In a search of sequence databases, it was found, for example, that the nucleic acid sequence of this invention has 5395 of 6175 bases (87%) identical to a gb:GENBANK-ID:AB025412|acc:AB025412.1 mRNA from *Mus musculus* (*Mus musculus* mRNA for Ten-m3, complete cds).

A disclosed NOV15c polypeptide (SEQ ID NO:40) encoded by SEQ ID NO:39 has 2628 amino acid residues and is presented in Table 15F using the one-letter code.

NOV15c seems to be a Type II (Ncyt Cexo) membrane protein with an INTEGRAL Likelihood of −9.39 for Transmembrane 216–232 (212–244). Although PSORT suggests that the TEN-M3-like protein may be localized in the nucleus, the protein of CuraGen Acc. No. CG55069-03 predicted here is similar to the membrane protein family, some members of which are secreted or are membrane bound. Therefore it is likely that this novel TEN-M3-like protein shows similar localization. The SignalP, Psort and/or Hydropathy results predict that NOV15c has no signal peptide and is likely to be localized in the nucleus with a certainty of 0.8000. In an alternative embodiment, NOV15c is likely to be localized to the plasma membrane with a certainty of 0.7900, or to the microbody (peroxisome) with a certainty of 0.3577, or to the Golgi body with a certainty of 0.3000.

TABLE 15F

NOV15c protein sequence

| |
|---|
| MDVKERRPYCSLTKSRREKERRYTNSSADNEECRVPTQKSYSSSETLKAFDHDSSRLLYG (SEQ ID NO:40) |
| NRVKDLVHREADEFTRQEQPASNQGQSTLQPLPPSHKQHSAQHHPSITSLNRNSLTNRRN |
| QSPAPPAALPAELQTTPESVQLQDSWVLGSNVPLESRHFLFKTGTGTTPLFSTATPGYTM |
| ASGSVYSPPTRPLPRNTLSRSAFKFKKSSKYCSWKCTALCAVGVSVLLAILLSYFIAMHL |
| FGLNWQLQQTENDTFENGKVNSDTMPTNTVSLPSGDNGKLGGFTQENNTIDSGELDIGRR |
| AIQEIPPGIFWRSQLFIDQPQFLKFNISLQKDALIGVYGRKGLPPSHTQYDFVELLDGSR |
| LIAREQRSLLETERAGRQARSVSLHEAGFIQYLDSGIWHLAFYNDGKNAEQVSFNTIVIE |
| SVVECPRNCHGNGECVSGTCHCFPGFLGPDCSRAACPVLCSGNGQYSKGRCLCFSGWKGT |
| ECDVPTTQCIDPQCGGRGICIMGSCACNSGYKGKSCEEADCIDPGCSNHGVCIHGECHCS |
| PGWGGSNCEILKTMCPDQCSGHGTYLQESGSCTCDPNWTGPDCSNEICSVDCGSHGVCMG |
| GTCRCEEGWTGPACNQRACHPRCAEHGTCKDGKCECSQGWNGEHCTIAHYLDKIVKDKIG |
| YKEGCPGLCNSNGRCTLDQNGGHCVCQPGWRGAGCDVAMETLCTDSKDNEGDGLIDCMDP |
| DCCLQSSCQNQPYCRGLPDPQDIISQSLQSPSQQAAKSFYDRISFLIGSDSTHVIPGESP |
| FNKSLASVIRGQVLTADGTPLIGVNVSFFHYPEYGYTITRQDGMFDLVANGGASLTLVFE |
| RSPFLTQYHTVWIPWNVFYVMDTLVMEKEENDIPSCDLSGFVRPNPIIVSSPLSTFFRSS |
| PEDSPIIPETQVLHEETTIPGTDLKLSYLSSRAAGYKSVLKITMTQSIIPFNLMKVHLMV |
| AVVGRLFQKWFPASPNLAYTFIWDKTDAYNQKVYGLSEAVVSVGYEYESCLDLTLWEKRT |
| AILQGYELDASNMGGWTLDKHHVLDVQNGILYKGNGENQFISQQPPVVSSIMGNGRRRSI |
| SCPSCNGQADGNKLLAPVALACGIDGSLYVGDFNYVRRIFPSGNVTSVLELRNKDFRHSS |
| NPAHRYYLATDPVTGDLYVSDTNTRRIYRPKSLTGAKDLTKNAEVVAGTGEQCLPFDEAR |
| CGDGGKAVEATLMSPKGMAVDKNGLIYFVDGTMIRKVDQNGIISTLLGSNDLTSARPLTC |
| DTSMHISQVRLEWPTDLAINPMDNSIYVLDNNVVLQITENRQVRIAAGRPMHCQVPGVEY |
| PVGKHAVQTTLESATAIAVSYSGVLYITETDEKKINRIRQVTTDGEISLVAGIPSECDCK |
| NDANCDCYQSGDGYAKDAKLSAPSSLAASPDGTLYIADLGNIRIRAVSKNKPLLNSMNFY |
| EVASPTDQELYIFDINGTHQYTVSLVTGDYLYNFSYSNDNDITAVTDSNGNTLRIRRDPN |
| RMPVRVVSPDNQVIWLTIGTNGCLKGMTAQGLELVLFTYHGNSGLLATKSDETGWTTFFD |
| YDSEGRLTNVTFPTGVVTNLHGDMDKAITVDIESSSREEDVSITSNLSSIDSFYTMVQDQ |
| LRNSYQIGYDGSLRIIYASGLDSHYQTEPHVLAGTANPTVAKRNMTLPGENGQNLVEWRF |
| RKEQAQGKVNVFGRKLRVNGRNLLSVDFDRTTKTEKIYDDHRKFLLRIAYDTSGHPTLWL |
| PSSKLMAVNVTYSSTGQIASIQRGTTSEKVDYDGQGRIVSRVFADGKTWSYTYLEKSMVL |
| LLHSQRQYIFEYDMWDRLSAITMPSVARHTMQTIRSIGYYRNIYNPPESNASIITDYNEE |
| GLLLQTAFLGTSRRVLFKYRRQTRLSEILYDSTRVSFTYDETAGVLKTVNLQSDGFICTI |
| RYRQIGPLIDRQIFRFSEDGMVNARFDYSYDNSFRVTSMQGVINETPLPIDLYQFDDISG |
| KVEQFGKFGVIYYDINQIISTAVMTYTKHFDAHGRIKEIQYEIFRSLMYWITIQYDNMGR |
| VTKREIKIGPFANTTKYAYEYDVDGQLQTVYLNEKIMWRYNYDLNGNLHLLNPSNSARLT |
| PLRYDLRDRITRLGDVQYRLDEDGFLRQRGTEIFEYSSKGLLTRVYSKGSGWTVIYRYDG |

TABLE 15F-continued

NOV15c protein sequence

LGRRVSSKTSLGQHLQFFYADLTYPTRITHVYNHSSSEITSLYYDLQGHLFAMEISSGDE

FYIASDNTGTPLAVFSSNGLMLKQIQYTAYGEIYFDSNIDFQLVIGFHGGLYDPLTKLIH

FGERDYDILAGRWTTPDIEIWKRIGKDPAPFNLYMFRNNNPASKIHDVKDYITDVNSWLV

TFGFHLHNAIPGFPVPKFDLTEPSYELVKSQQWDDIPPIFGVQQQVARQAKAFLSLGKMA

EVQVSRRRAGGAQSWLWFATVKSLIGKGVMLAVSQGRVQTNVLNIANEDCIKVAAVLNNA

FYLENLHFTIEGKDTHYFIKTTTPESDLGTLRLTSGRKALENGINVTVSQSTTVVNGRTR

RFADVEMQFGALALHVRYGMTLDEEKARILEQARQRALARAWAREQQRVRDGEEGARLWT

EGEKRQLLSAGKVQGYDGYYVLSVEQYPELADSANNIQFLRQSEIGRR

The full amino acid sequence of the protein of the invention was found to have 2505 of 2575 amino acid residues (97%) identical to, and 2537 of 2575 amino acid residues (98%) similar to, the 2715 amino acid residue ptnr:SPTREMBL-ACC:Q9WTS6 protein from *Mus musculus* (Mouse) (TEN-M3).

The TEN-M3-like gene disclosed in this invention is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea and uterus.

The nucleic acids and proteins of the invention have applications in the diagnosis and/or treatment of various diseases and disorders. For example, the compositions of the present invention will have efficacy for the treatment of patients suffering from: CNS disorders, neuronal developmental disorders, heart diseases such as stroke, myocardial infarction, ischemia, cancer, localized and systemic scleroderma, pleural inflammatory and fibrotic diseases as well as other diseases, disorders and conditions.

NOV15d

A disclosed NOV15d nucleic acid of 8487 nucleotides (also referred to as CG55069-08) (SEQ ID NO:41) encoding a novel TEN-M3-like protein is shown in Table 15G. An open reading frame was identified beginning with an ATG initiation codon at nucleotides 299–301 and ending with a TAA codon at nucleotides 8138–8140. Putative untranslated regions upstream from the initiation codon and downstream from the termination codon are underlined and the start and stop codons are in bold in Table 15G.

TABLE 15G

NOV15d nucleotide sequence (SEQ ID NO:41)
ACTCACTATAGGGCTCGAGCGGCCGCCCGGGCAGGTCCCATTTGACAGAAAAAGGCAGTAAACGGGGAAT

CTCTTTTTTTGAATAAAGAAGAAGAAGAAATAAAGTACCTGTCATCTTGACAAGTGGCGGAGCGGAGGAG

TCAAGGATTATAAATGATCACAGCCAGGTCCAGCTCGCCCCGTGATTGGGCTCTCCCGCGATCTGCACCG

GGGGAAGCGCATGAGAGGCCAATGAGACTTGAACCCTGAGCCTAAGTTGTCACCAGCAGGACTGATGTGC

ACACAGAAGGAATGAAGTATGGATGTGAAAGAACGCAGGCCTTACTGCTCCCTGACCAAGAGCAGACGAG

AGAAGGAACGGCGCTACACAAATTCCTCCGCAGACAATGAGGAGTGCCGGGTACCCACACAGAAGTCCTA

CAGTTCCAGCGAGACATTGAAAGCTTTTGATCATGATTCCTCGCGGCTGCTTTACGGCAACAGAGTGAAG

GATTTGGTTCACAGAGAAGCAGACGAGTTCACTAGACAAGAGCAACCTGCAAGCAATCAAGGCCAGTCTA

CCCTGCAGCCCTTGCCGCCTTCCCATAAGCAGCACTCTGCACAGCATCATCCATCCATCACTTCTCTCAA

CAGAAACTCCCTGACCAATAGAAGGAACCAGAGTCCGGCCCCGCCGGCTGCTTTGCCCGCCGAGCTGCAA

ACCACACCCGAGTCCGTCCAGCTGCAGGACAGCTGGGTCCTTGGCAGTAATGTACCACTGGAAAGCAGGC

ATTTCCTATTCAAAACAGGAACAGGTACAACGCCACTGTTCAGTACTGCAACCCCAGGATACACAATGGC

ATCTGGCTCTGTTTATTCACCACCTACTCGGCCACTACCTAGAAACACCCTATCAAGAAGTGCTTTTAAA

TTCAAGAAGTCTTCAAAGTACTGTAGCTGGAAATGCACTGCACTGTGTGCCGTAGGGGTCTCGGTGCTCC

TGGCAATACTCCTGTCTTATTTTATAGCAATGCATCTCTTTGGCCTCAACTGGCAGCTACAGCAGACTGA

TABLE 15G-continued

NOV15d nucleotide sequence

AAATGACACATTTGAGAATGGAAAAGTGAATTCTGATACCATGCCAACAAACACTGTGTCATTACCTTCT
GGAGACAATGGAAAATTAGGTGGATTTACGCAAGAAAATAACACCATAGATTCCGGAGAACTTGATATTG
GCCGAAGAGCAATTCAAGAGATTCCTCCCGGGATCTTCTGGAGATCACAGCTCTTCATTGATCAGCCACA
GTTTCTTAAATTCAATATCTCTCTTCAGAAGGATGCATTGATTGGAGTATATGGCCGGAAAGGCTTACCG
CCTTCCCATACTCAGTATGACTTCGTGGAGCTCCTGGATGGCAGCAGGCTGATTGCCAGAGAGCAGCGGA
GCCTGCTTGAGACGGAGAGAGCCGGGCGGCAGGCGAGATCCGTCAGCCTTCATGAGGCCGGCTTTATCCA
GTACTTGGATTCTGGAATCTGGCATCTGGCTTTTTATAATGATGGGAAAAATGCAGAGCAGGTGTCTTTT
AATACCATTGTTATAGAGTCTGTGGTGGAATGTCCCCGAAATTGCCATGGAAATGGAGAATGCGTTTCTG
GAACTTGCCATTGTTTTCCAGGATTTCTGGGTCCGGATTGTTCAAGAGCCGCCTGTCCAGTGTTATGTAG
TGGCAACGGGCAGTACTCCAAGGGCCGCTGCCTGTGTTTCAGCGGCTGGAAGGGCACCGAGTGTGATGTG
CCGACTACCCAGTGTATTGACCCACAGTGTGGGGGTCGTGGGATTTGTATCATGGGCTCCTGTGCTTGCA
ACTCAGGATACAAAGGAGAAAGTTGTGAAGAAGCTGACTGTATAGACCCTGGGTGTTCTAATCATGGTGT
GTGTATCCACGGGGAATGTCACTGCAGTCCAGGATGGGGAGGTAGCAATTGTGAAATACTGAAGACCATG
TGTCCAGACCAGTGCTCCGGCCACGGAACGTATCTTCAAGAAAGTGGCTCCTGCACGTGTGACCCTAACT
GGACTGGCCCAGACTGCTCAAACGAAATATGTTCTGTGGACTGTGGCTCACACGGCGTTTGCATGGGGGG
GACGTGTCGCTGTGAAGAAGGCTGGACGGGCCCAACCTGTAATCAGAGAGCCTGCCACCCCCGCTGTGCC
GAGCACGGGACCTGCAAGGATGGCAAGTGTGAATGCAGCCATGGCTGGAATGGAGAGCACTGCACTATCG
AGGGTTGTCCTGGTCTGTGCAACAGCAATGGAAGATGTACCCTGGACCAAAATGGCTGGCATTGTGTGTG
CCAGCCTGGATGGAGAGGAGCAGGCTGTGACGTAGCCATGGAGACTCTTTGCACAGATAGCAAGGACAAT
GAAGGAGATGGACTCATTGACTGCATGGATCCCGATTGCTGCCTACAGAGTTCCTGCCAGAATCAGCCCT
ATTGTCGGGGACTGCCGGATCCTCAGGACATCATTAGCCAAAGCCTTCAATCGCCTTCTCAGCAAGCTGC
CAAATCCTTTTATGATCGAATCAGTTTCCTTATAGGATCTGATAGCACCCATGTTATACCTGGAGAAAGT
CCTTTCAATAAGAGCCTTGCATCTGTCATCAGAGGCCAAGTACTGACTGCTGATGGAACTCCACTTATTG
GAGTAAATGTCTCGTTTTTCCATTACCCAGAATATGGATATACTATTACCCGCCAGGACGGAATGTTTGA
CTTGGTGGCAAATGGTGGGGCCTCTCTAACTTTGGTATTTGAACGATCCCCATTCCTCACTCAGTATCAT
ACTGTGTGGATTCCATGGAATGTCTTTTATGTGATGGATACCCTAGTCATGGAGAAAGAAGAGAATGACA
TTCCCAGCTGTGATCTGAGTGGATTCGTGAGGCCAAATCCCATCATTGTGTCATCACCTTTATCCACCTT
TTTCAGATCTTCTCCTGAAGACAGTCCCATCATTCCCGAAACACAGGTACTCCACGAGGAAACTACAATT
CCAGGAACAGATTTGAAACTCTCCTACTTGAGTTCCAGAGCTGCAGGGTATAAGTCAGTTCTCAAGATCA
CCATGACCCAGTCTATTATTCCATTTAATTTAATGAAGGTTCATCTTATGGTAGCTGTAGTAGGAAGACT
CTTCCAAAAGTGGTTTCCTGCCTCACCAAACTTGGCCTATACTTTCATATGGATAAAACAGATGCATAT
AATCAGAAAGTCTATGGTCTATCTGAAGCTGTTGTGTCAGTTGGATATGAGTATGAGTCGTGTTTGGACC
TGACTCTGTGGGAAAAGAGGACTGCCATTCTGCAGGGCTATGAATTGGATGCGTCCAACATGGGTGGCTG
GACATTAGATAAACATCACGTGCTGGATGTACAGAACGGTATACTGTACAAGGGAAACGGGGAAAACCAG
TTCATCTCCCAGCAGCCTCCAGTCGTGAGTAGCATCATGGGCAATGGGCGAAGGCGCAGCATTTCCTGCC
CCAGTTGCAATGGTCAAGCTGATGGTAACAAGTTACTGGCCCCAGTGGCGCTAGCTTGTGGGATCGATGG
CAGTCTGTACGTAGGCGATTTCAACTACGTGCGGCGGATATTCCCTTCTGGAAATGTAACAAGTGTCTTA
GAACTAAGAAATAAAGATTTTAGACATAGCAGCAACCCAGCTCATAGATACTACCTTGCAACGGATCCAG

TABLE 15G-continued

NOV15d nucleotide sequence

```
TCACGGGAGATCTGTACGTTTCTGACACAAACACCCGCAGAATTTATCGCCCAAAGTCACTTACGGGGC
AAAAGACTTGACTAAAAATGCAGAAGTCGTCGCAGGGACAGGGGAGCAATGCCTTCCGTTTGACGAGGCG
AGATGTGGGGATGGAGGGAAGGCCGTGGAAGCCACACTCATGAGTCCCAAAGGAATGGCAGTTGATAAGA
ATGGATTAATCTACTTTGTTGATGGAACCATGATTAGGAAAGTTGACCAAAATGGAATCATATCAACTCT
TCTGGGCTCTAACGATTTGACTTCAGCCAGACCTTTAACTTGTGACACCAGCATGCACATCAGCCAGGTA
CGTCTGGAATGGCCCACTGACCTAGCCATTAACCCTATGGATAACTCCATTTATGTCCTGGATAATAATG
TAGTTTTACAGATCACTGAAAATCGTCAAGTTCGCATTGCTGCTGGACGGCCCATGCACTGTCAGGTTCC
CGGAGTGGAATATCCTGTGGGGAAGCACGCGGTGCAGACAACACTGGAATCAGCCACTGCCATTGCTGTG
TCCTACAGTGGGGTCCTGTACATTACTGAAACTGATGAGAAGAAAATTAACCGGATAAGGCAGGTCACAA
CAGATGGAGAAATCTCCTTAGTGGCCGGAATACCTTCAGAGTGTGACTGCAAAAATGATGCCAACTGTGA
CTGTTACCAGAGTGGAGATGGCTACGCCAAGGATGCCAAACTCAGTGCCCCATCCTCCCTGGCTGCTTCT
CCAGATGGTACACTGTATATTGCAGATCTAGGGAATATCCGGATCCGGGCTGTGTCAAAGAATAAGCCTT
TACTTAACTCTATGAACTTCTATGAAGTTGCGTCTCCAACTGATCAAGAACTCTACATCTTTGACATCAA
TGGTACTCACCAATATACTGTAAGTTTAGTCACTGGTGATTACCTTTACAATTTTAGCTACAGCAATGAC
AATGATATTACTGCTGTGACAGACAGCAATGGCAACACCCTTAGAATTAGACGGGACCCAAATCGCATGC
CAGTTCGAGTGGTGTCTCCTGATAACCAAGTGATATGGTTGACAATAGGAACAAATGGATGTTTGAAAGG
CATGACTGCTCAAGGACTGGAATTAGTTTTGTTTACTTACCATGGCAATAGTGGCCTTTTAGCCACTAAA
AGTGATGAAACTGGATGGACAACGTTTTTTGACTATGACAGTGAAGGTCGTCTGACAAATGTTACGTTTC
CAACTGGAGTGGTCACAAACCTGCATGGGACATGGACAAGGCTATCACAGTGGACATTGAGTCATCTAG
CCGAGAAGAAGATGTCAGCATCACTTCAAATCTGTCCTCGATCGATTCTTTCTACACCATGGTTCAAGAT
CAGTTAAGAAACAGCTACCAGATTGGTTATGACGGCTCCCTCAGAATTATCTACGCCAGTGGCCTGGACT
CACACTACCAAACAGAGCCGCACGTTCTGGCTGGCACCGCTAATCCGACGGTTGCCAAAAGAAACATGAC
TTTGCCTGGCGAGAACGGTCAAAACTTGGTGGAATGGAGATTCCGAAAAGAGCAAGCCCAAGGGAAAGTC
AATGTCTTTGGCCGCAAGCTCAGGGTTAATGGCAGAAACCTCCTTTCAGTTGACTTTGATCGAACAACAA
AGACAGAAAAGATCTATGACGACCACCGTAAATTTCTACTGAGGATCGCCTACGACACGTCTGGGCACCC
GACTCTCTGGCTGCCAAGCAGCAAGCTGATGGCCGTCAATGTCACCTATTCATCCACAGGTCAAATTGCC
AGCATCCAGCGAGGCACCACTAGCGAGAAAGTAGATTATGACGGACAGGGGAGGATCGTGTCTCGGGTCT
TTGCTGATGGTAAAACATGGAGTTACACATATTTAGAAAAGTCCATGGTTCTTCTGCTTCATAGCCAGCG
GCAGTACATCTTCGAATACGATATGTGGGACCGCCTGTCTGCCATCACCATGCCCAGTGTGGCTCGCCAC
ACCATGCAGACCATCCGATCCATTGGCTACTACCGCAACATATACAACCCCCGGAAAGCAACGCCTCCA
TCATCACGGACTACAACGAGGAAGGGCTGCTTCTACAAACAGCTTTCTTGGGTACAAGTCGGAGGGTCTT
ATTCAAATACAGAAGGCAGACTAGGCTCTCAGAAATTTTATATGATAGCACAAGAGTCAGTTTTACCTAT
GATGAAACAGCAGGAGTCCTAAAGACAGTAAACCTCCAGAGTGATGGTTTTATTTGCACCATTAGATACA
GGCAAATTGGTCCCCTGATTGACAGGCAGATTTTCCGCTTTAGTGAAGATGGGATGGTAAATGCAAGATT
TGACTATAGCTATGACAACAGCTTTCGAGTGACCAGCATGCAGGGTGTGATCAATGAAACGCCACTGCCT
ATTGATCTGTATCAGTTTGATGACATTTCTGGCAAAGTTGAGCAGTTTGGAAAGTTTGGAGTTATATATT
ATGATATTAACCAGATCATTTCTACAGCTGTAATGACCTATACGAAGCACTTTGATGCTCATGGCCGTAT
```

TABLE 15G-continued

NOV15d nucleotide sequence

CAAGGAGATTCAATATGAGATATTCAGGTCGCTCATGTACTGGATTACAATTCAGTATGATAACATGGGT
CGGGTAACCAAGAGAGAGATTAAAATAGGGCCCTTTGCCAACACCACCAAATATGCTTATGAATATGATG
TTGATGGACAGCTCCAAACAGTTTACCTCAATGAAAAGATAATGTGGCGGTACAACTACGATCTGAATGG
AAACCTCCATTTACTGAACCCAAGTAACAGTGCGCGTCTGACACCCCTTCGCTATGACCTGCGAGACAGA
ATCACTCGACTGGGTGATGTTCAATATCGGTTGGATGAAGATGGTTTCCTACGTCAAAGGGGCACGGAAA
TCTTTGAATATAGCTCCAAGGGGCTTCTAACTCGAGTTTACAGTAAAGGCAGTGGCTGGACAGTGATCTA
CCGTTATGACGGCCTGGGAAGGCGTGTTTCTAGCAAAACCAGTCTAGGACAGCACCTGCAGTTTTTTTAT
GCTGACTTAACTTATCCCACTAGGATTACTCATGTCTACAACCATTCGAGTTCAGAAATTACCTCCCTGT
ATTATGATCTCCAAGGACATCTTTTTGCCATGGAAATCAGCAGTGGGGATGAATTCTATATTGCATCGGA
TAACACAGGGACACCACTGGCTGTGTTCAGTAGCAATGGGCTTATGCTGAAACAGATTCAGTACACTGCA
TATGGGAAATCTATTTTGACTCTAATATTGACTTTCAACTGGTAATTGGATTTCATGGTGGCCTGTATG
ACCCACTCACCAAATTAATCCACTTTGGAGAAAGAGATTATGACATTTTGGCAGGACGGTGGACAACACC
TGACATAGAAATCTGGAAAAGAATTGGGAAGGACCCAGCTCCTTTTAACTTGTACATGTTTAGGAATAAC
AACCCTGCAAGCAAAATCCATGACGTGAAAGATTACATCACAGATGTTAACAGCTGGCTGGTGACATTTG
GTTTCCATCTGCACAATGCTATTCCTGGATTCCCTGTTCCCAAATTTGATTTAACAGAACCTTCTTACGA
ACTTGTGAAGAGTCAGCAGTGGGATGATATACCGCCCATCTTCGGAGTCCAGCAGCAAGTGGCGCGGCAG
GCCAAGGCCTTCCTGTCGCTGGGGAAGATGGCCGAGGTGCAGGTGAGCCGGCGCCGGGCCGGCGGCGCGC
AGTCCTGGCTGTGGTTCGCCACGGTCAAGTCGCTGATCGGCAAGGGCGTCATGCTGGCCGTCAGCCAGGG
CCGCGTGCAGACCAACGTGCTCAACATCGCCAACGAGGACTGCATCAAGGTGGCGGCCGTGCTCAACAAC
GCCTTCTACCTGGAGAACCTGCACTTCACCATCGAGGGCAAGGACACGCACTACTTCATCAAGACCACCA
CGCCCGAGAGCGACCTGGGCACGCTGCGGTTGACCAGCGGCCGCAAGGCGCTGGAGAACGGCATCAACGT
GACGGTGTCGCAGTCCACCACGGTGGTGAACGGCAGGACGCGCAGGTTCGCGGACGTGGAGATGCAGTTC
GGCGCGCTGGCGCTGCACGTGCGCTACGGCATGACCCTGGACGAGGAGAAGGCGCGCATCCTGGAGCAGG
CGCGGCAGCGCGCGCTCGCCCGGGCCTGGGCGCGCGAGCAGCAGCGCGTGCGCGACGGCGAGGAGGGCGC
GCGCCTCTGGACGGAGGGCGAGAAGCGGCAGCTGCTGAGCGCCGGCAAGGTGCAGGGCTACGACGGGTAC
TACGTACTCTCGGTGGAGCAGTACCCCGAGCTGGCCGACAGCGCCAACAACATCCAGTTCCTGCGGCAGA
GCGAGATCGGCAGGAGGTAA<u>CGCCCGGGCCGCGCCCGCCGAGCCGCTCACGCCCTGCCCACATTGTCCTG</u>
<u>TGGCACAACCCGAGTGGGACTCTCCAACGCCCAAGAGCCTTCCTCCCGGGGAATGAGACTGCTGTTACG</u>
<u>ACCCACACCCACACCGCGAAAACAAGGACCGCTTTTTTCCGAATGACCTTAAAGGTGATCGGCTTTAACG</u>
<u>AATATGTTTACATATGCATAGCGCTGCACTCAGTCGGACTGAACGTAGCCAGAGGAAAAAAAAATCATCA</u>
<u>AGGACAAAGGCCTCGACCTGTTGCGCTGGGCCGTCTGTTCCTTCTAGGCACTGTATTTAACTAACTTTAA</u>
<u>AAAAAAAAAAAAAAAG</u>

The TEN-M3 NOV15d disclosed in this invention maps to chromosome 4.

In a search of sequence databases, it was found, for example, that the nucleic acid sequence of this invention has 5307 of 5309 bases (99%) identical to a gb:GENBANK-ID:AB040888|acc:AB040888.1 mRNA from *Homo sapiens* (*Homo sapiens* mRNA for KIAA1455 protein, partial cds).

A disclosed NOV15d polypeptide (SEQ ID NO:42) encoded by SEQ ID NO:41 has 2613 amino acid residues and is presented in Table 15H using the one-letter code. NOV15d seems to be a Type II (Ncyt Cexo) membrane protein with an INTEGRAL Likelihood of −9.39 for Transmembrane 216–232 (212–244). Although PSORT suggests that the TEN-M3-like protein may be localized in the nucleus, the protein of CuraGen Acc. No. CG55069_08 predicted here is similar to the TEN-M3 family, some members of which are membrane localized. Therefore it is likely that this novel TEN-M3-like protein is localized to the same sub-cellular compartment. The SignalP, Psort and/or Hydropathy results predict that NOV15d has no signal peptide and is likely to be localized in the nucleus with a certainty of 0.8000. In an alternative embodiment, NOV15d is likely to be localized to the plasma membrane with a certainty of 0.7900, or to the microbody (peroxisome) with a certainty of 0.3642, or to the Golgi body with a certainty of 0.3000.

TABLE 15H

NOV15d protein sequence

MDVKERRPYCSLTKSRREKERRYTNSSADNEECRVPTQKSYSSSETLKAFDHDSSRLLYG (SEQ ID NO:42)

NRVKDLVHREADEFTRQEQPASNQGQSTLQPLPPSHKQHSAQHHPSITSLNRNSLTNRRN

QSPAPPAALPAELQTTPESVQLQDSWVLGSNVPLESRHFLFKTGTGTTPLFSTATPGYTM

ASGSVYSPPTRPLPRNTLSRSAFKFKKSSKYCSWKCTALCAVGVSVLLAILLSYFIAMHL

FGLNWQLQQTENDTFENGKVNSDTMPTNTVSLPSGDNGKLGGFTQENNTIDSGELDIGRR

AIQEIPPGIFWRSQLFIDQPQFLKFNISLQKDALIGVYGRKGLPPSHTQYDFVELLDGSR

LIAREQRSLLETERAGRQARSVSLHEAGFIQYLDSGIWHLAFYNDGKNAEQVSFNTIVIE

SVVECPRNCHGNGECVSGTCHCFPGFLGPDCSRAACPVLCSGNGQYSKGRCLCFSGWKGT

ECDVPTTQCIDPQCGGRGICIMGSCACNSGYKGESCEEADCIDPGCSNHGVCIHGECHCS

PGWGGSNCEILKTMCPDQCSGHGTYLQESGSCTCDPNWTGPDCSNEICSVDCGSHGVCMG

GTCRCEEGWTGPTCNQRACHPRCAEHGTCKDGKCECSHGWNGEHCTIEGCPGLCNSNGRC

TLDQNGWHCVCQPGWRGAGCDVAMETLCTDSKDNEGDGLIDCMDPDCCLQSSCQNQPYCR

GLPDPQDIISQSLQSPSQQAAKSFYDRISFLIGSDSTHVIPGESPFNKSLASVIRGQVLT

ADGTPLIGVNVSFFHYPEYGYTITRQDGMFDLVANGGASLTLVFERSPFLTQYHTVWIPW

NVFYVMDTLVMEKEENDIPSCDLSGFVRPNPIIVSSPLSTFFRSSPEDSPIIPETQVLHE

ETTIPGTDLKLSYLSSRAAGYKSVLKITMTQSIIPFNLMKVHLMVAVVGRLFQKWFPASP

NLAYTFIWDKTDAYNQKVYGLSEAVVSVGYEYESCLDLTLWEKRTAILQGYELDASNMGG

WTLDKHHVLDVQNGILYKGNGENQFISQQPPVVSSIMGNGRRRSISCPSCNGQADGNKLL

APVALACGIDGSLYVGDFNYVRRIFPSGNVTSVLELRNKDFRHSSNPAHRYYLATDPVTG

DLYVSDTNTRRIYRPKSLTGAKDLTKNAEVVAGTGEQCLPFDEARCGDGGKAVEATLMSP

KGMAVDKNGLIYFVDGTMIRKVDQNGIISTLLGSNDLTSARPLTCDTSMHISQVRLEWPT

DLAINPMDNSIYVLDNNVVLQITENRQVRIAAGRPMHCQVPGVEYPVGKHAVQTTLESAT

AIAVSYSGVLYITETDEKKINRIRQVTTDGEISLVAGIPSECDCKNDANCDCYQSGDGYA

KDAKLSAPSSLAASPDGTLYIADLGNIRIRAVSKNKPLLNSMNFYEVASPTDQELYIFDI

NGTHQYTVSLVTGDYLYNFSYSNDNDITAVTDSNGNTLRIRRDPNRMPVRVVSPDNQVIW

LTIGTNGCLKGMTAQGLELVLFTYHGNSGLLATKSDETGWTTFFDYDSEGRLTNVTFPTG

VVTNLHGDMDKAITVDIESSSREEDVSITSNLSSIDSFYTMVQDQLRNSYQIGYDGSLRI

IYASGLDSHYQTEPHVLAGTANPTVAKRNMTLPGENGQNLVEWRFRKEQAQGKVNVFGRK

LRVNGRNLLSVDFDRTTKTEKIYDDHRKFLLRIAYDTSGHPTLWLPSSKLMAVNVTYSST

TABLE 15H-continued

NOV15d protein sequence

```
GQIASIQRGTTSEKVDYDGQGRIVSRVFADGKTWSYTYLEKSMVLLLHSQRQYIFEYDMW
DRLSAITMPSVARHTMQTIRSIGYYRNIYNPPESNASIITDYNEEGLLLQTAFLGTSRRV
LFKYRRQTRLSEILYDSTRVSFTYDETAGVLKTVNLQSDGFICTIRYRQIGPLIDRQIFR
FSEDGMVNARFDYSYDNSFRVTSMQGVINETPLPIDLYQFDDISGKVEQFGKFGVIYYDI
NQIISTAVMTYTKHFDAHGRIKEIQYEIFRSLMYWITIQYDNMGRVTKREIKIGPFANTT
KYAYEYDVDGQLQTVYLNEKIMWRYNYDLNGNLHLLNPSNSARLTPLRYDLRDRITRLGD
VQYRLDEDGFLRQRGTEIFEYSSKGLLTRVYSKGSGWTVIYRYDGLGRRVSSKTSLGQHL
QFFYADLTYPTRITHVYNHSSSEITSLYYDLQGHLFAMEISSGDEFYIASDNTGTPLAVF
SSNGLMLKQIQYTAYGEIYFDSNIDFQLVIGFHGGLYDPLTKLIHFGERDYDILAGRWTT
PDIEIWKRIGKDPAPFNLYMFRNNNPASKIHDVKDYITDVNSWLVTFGFHLHNAIPGFPV
PKFDLTEPSYELVKSQQWDDIPPIFGVQQQVARQAKAFLSLGKMAEVQVSRRRAGGAQSW
LWFATVKSLIGKGVMLAVSQGRVQTNVLNIANEDCIKVAAVLNNAFYLENLHFTIEGKDT
HYFIKTTTPESDLGTLRLTSGRKALENGINVTVSQSTTVVNGRTRRFADVEMQFGALALH
VRYGMTLDEEKARILEQARQRALARAWAREQQRVRDGEEGARLWTEGEKRQLLSAGKVQG
YDGYYVLSVEQYPELADSANNIQFLRQSEIGRR
```

The full amino acid sequence of the protein of the invention was found to have 2496 of 2568 amino acid residues (97%) identical to, and 2527 of 2568 amino acid residues (98%) similar to, the 2715 amino acid residue ptnr:SPTREMBL-ACC:Q9WTS6 protein from *Mus musculus* (Mouse) (TEN-M3).

The TEN-M3-like gene disclosed in this invention is expressed in at least the following tissues: Adipose, Heart, Aorta, Coronary Artery, Parathyroid Gland, Pineal Gland, Colon, Spleen, Lymph node, Bone, Cartilage, Muscle, Smooth Muscle, Brain, Cerebellum, Right Cerebellum, Pituitary Gland, Temporal Lobe, Hippocampus, Cervix, Mammary gland/Breast, Ovary, Placenta, Uterus, Vulva, Prostate, Testis, Lung, Kidney, Retina, Skin, Dermis.

The nucleic acids and proteins of the invention have applications in the diagnosis and/or treatment of various diseases and disorders. For example, the compositions of the present invention will have efficacy for the treatment of patients suffering from: Cardiomyopathy, Atherosclerosis, Hypertension, Congenital heart defects, Aortic stenosis, Atrial septal defect (ASD), Atrioventricular (A-V) canal defect, Ductus arteriosus, Pulmonary stenosis, Subaortic stenosis, Ventricular septal defect (VSD), valve diseases, Tuberous sclerosis, Scleroderma, Obesity, Transplantation, Metabolic Disorders, Diabetes, Aneurysm, Fibromuscular dysplasia, Stroke, Myocardial infarction, Embolism, Cardiovascular disorders, Bypass surgery, Hyperparathyroidism, Hypoparathyroidism, Hyperthyroidism, Hypothyroidism, cancer, including but not limited to colon, lung, brain, leukemia, breast, ovarian, uterine, prostate, testicular, kidney and skin; SIDS, Lymphedema, Allergies, Osteoporosis, Hypercalceimia, Arthritis, Ankylosing spondylitis, Scoliosis; Tendinitis; Muscular dystrophy, Lesch-Nyhan syndrome, Myasthenia gravis; Von Hippel-Lindau (VHL) syndrome, Alzheimer's disease, Stroke, Tuberous sclerosis, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain, Neuroprotection; Endocrine dysfunctions, Growth and reproductive disorders; Fertility; Endometriosis, Autoimmune disease, Asthma, Emphysema, Scleroderma, ARDS, Psoriasis, Actinic keratosis, Tuberous sclerosis, Acne, Hair growth, allopecia, pigmentation disorders, Renal artery stenosis, Interstitial nephritis, Glomerulonephritis, Polycystic kidney disease, Systemic lupus erythematosus, Renal tubular acidosis, IgA nephropathy, Hypercalceimia, Lesch-Nyhan syndrome, CNS disorders, neuronal developmental disorders, heart diseases such as stroke, myocardial infarction, ischemia, localized and systemic scleroderma, pleural inflammatory and fibrotic diseases as well as other diseases, disorders and conditions.

NOV15a, NOV15b, NOV15c, and NOV15d share a high degree of homology as is shown in the amino acid alignment in Table 15I.

| Table 15I. Clustal W Alignment of NOV15a and NOV15b and NOV15c and NOV15d |
|---|

```
                    10        20        30        40        50        60        70        80
               ....|....|....|....|....|....|....|....|....|....|....|....|....|....|....|....|
145665404      MDVKERRPYCSLTKSRREKERRYTNSSADNEECRVPTQKSYSSSETLKAFDHDSSRLLYGNRVKDLVHREADEFTRQGQN
CG55069_02     MDVKERRPYCSLTKSRREKERRYTNSSADNEECRVPTQKSYSSSETLKAFDHDSSRLLYGNRVKDLVHREADEFTRQGQN
```

```
CG55069_03   MDVKERRPYCSLTKSRREKERRYTNSSADNEECRVPTQKSYSSSETLKAFDHDSSRLLYGNRVKDLVHREADEFTRC---
CG55069_08   MDVKERRPYCSLTKSRREKERRYTNSSADNEECRVPTQKSYSSSETLKAFDHDSSRLLYGNRVKDLVHREADEFTRC---

90        100       110       120       130       140       150       160
                 ....|....|....|....|....|....|....|....|....|....|....|....|....|....|....|....|
145665404    FTLRQLGVCEPATRRGLAFCAEMGLPHRGYSISAGSDADTENEAVMSPEHAMRLWGRGVKSGRSSCLSSRSNSALTLTDT
CG55069_02   FTLRQLGVCEPATRRGLAFCAEMGLPHRGYSISAGSDADTENEAVMSPEHAMRLWGRGVKSGRSSCLSSRSNSALTLTDT
CG55069_03   --------------------------------------------------------------------------------
CG55069_08   --------------------------------------------------------------------------------

170       180       190       200       210       220       230       240
                 ....|....|....|....|....|....|....|....|....|....|....|....|....|....|....|....|
145665404    EHENKSDSENEQPASNQGQSTLQPLPPSHKQHSAQHHPSITSLNRNSLTNRRNQSPAPPAALPAELQTTPESVQLQDSWV
CG55069_02   EHENKSDSENEQPASNQGQSTLQPLPPSHKQHSAQHHPSITSLNRNSLTNRRNQSPAPPAALPAELQTTPESVQLQDSWV
CG55069_03   ----------EQPASNQGQSTLQPLPPSHKQHSAQHHPSITSLNRNSLTNRRNQSPAPPAALPAELQTTPESVQLQDSWV
CG55069_08   ----------EQPASNQGQSTLQPLPPSHKQHSAQHHPSITSLNRNSLTNRRNQSPAPPAALPAELQTTPESVQLQDSWV 250       260       270       280       290       300       310       320
                 ....|....|....|....|....|....|....|....|....|....|....|....|....|....|....|....|
145665404    LGSNVPLESRHFLFKTGTGTTPLFSTATPGYTMASGSVYSPPTRPLPRNTLSRSAFKFKKSSKYCSWKCTALCAVGVSVL
CG55069_02   LGSNVPLESRHFLFKTGTGTTPLFSTATPGYTMASGSVYSPPTRPLPRNTLSRSAFKFKKSSKYCSWKCTALCAVGVSVL
CG55069_03   LGSNVPLESRHFLFKTGTGTTPLFSTATPGYTMASGSVYSPPTRPLPRNTLSRSAFKFKKSSKYCSWKCTALCAVGVSVL
CG55069_08   LGSNVPLESRHFLFKTGTGTTPLFSTATPGYTMASGSVYSPPTRPLPRNTLSRSAFKFKKSSKYCSWKCTALCAVGVSVL 330       340       350       360       370       380       390       400
                 ....|....|....|....|....|....|....|....|....|....|....|....|....|....|....|....|
145665404    LAILLSYFIAMHLFGLNWQLQQTENDTFENGKVNSDTMPTNTVSLPSGDNGKLGGFTQENNTIDSGELDIGRRAIQEIPP
CG55069_02   LAILLSYFIAMHLFGLNWQLQQTENDTFENGKVNSDTMPTNTVSLPSGDNGKLGGFTQENNTIDSGELDIGRRAIQEIPP
CG55069_03   LAILLSYFIAMHLFGLNWQLQQTENDTFENGKVNSDTMPTNTVSLPSGDNGKLGGFTQENNTIDSGELDIGRRAIQEIPP
CG55069_08   LAILLSYFIAMHLFGLNWQLQQTENDTFENGKVNSDTMPTNTVSLPSGDNGKLGGFTQENNTIDSGELDIGRRAIQEIPP 410       420       430       440       450       460       470       480
                 ....|....|....|....|....|....|....|....|....|....|....|....|....|....|....|....|
145665404    GIFWRSQLFIDQPQFLKFNISLQKDALIGVYGRKKLPPSHTQSSPQYDFVELLDGSRLIAREQRSLLETERAGRQARSVS
CG55069_02   GIFWRSQLFIDQPQFLKFNISLQKDALIGVYGRKGLPPSHT----QYDFVELLDGSRLIAREQRSLLETERAGRQARSVS
CG55069_03   GIFWRSQLFIDQPQFLKFNISLQKDALIGVYGRKGLPPSHT----QYDFVELLDGSRLIAREQRSLLETERAGRQARSVS
CG55069_08   GIFWRSQLFIDQPQFLKFNISLQKDALIGVYGRKGLPPSHT----QYDFVELLDGSRLIAREQRSLLETERAGRQARSVS 490       500       510       520       530       540       550       560
                 ....|....|....|....|....|....|....|....|....|....|....|....|....|....|....|....|
145665404    LHEAGFIQYLDSGIWHLAFYNDGKNAEQVSFNTIVIESVVECPRNCHGNGECVSGTCHCFPGFLGPDCSRAACPVLCSGN
CG55069_02   LHEAGFIQYLDSGIWHLAFYNDGKNAEQVSFNTIVIESVVECPRNCHGNGECVSGTCHCFPGFLGPDCSRAACPVLCSGN
CG55069_03   LHEAGFIQYLDSGIWHLAFYNDGKNAEQVSFNTIVIESVVECPRNCHGNGECVSGTCHCFPGFLGPDCSRAACPVLCSGN
CG55069_08   LHEAGFIQYLDSGIWHLAFYNDGKNAEQVSFNTIVIESVVECPRNCHGNGECVSGTCHCFPGFLGPDCSRAACPVLCSGN 570       580       590       600       610       620       630       640
                 ....|....|....|....|....|....|....|....|....|....|....|....|....|....|....|....|
145665404    GQYSKGRCLCFSGWKGTECDVPTTQCIDPQCGGRGICIMGSCACSSGYKGESCEEADCIDPGCSNHGVCIHGECHCSPGW
CG55069_02   GQYSKGRCLCFSGWKGTECDVPTTQCIDPQCGGRGICIMGSCACSSGYKGESCEEADCIDPGCSNHGVCIHGECHCSPGW
CG55069_03   GQYSKGRCLCFSGWKGTECDVPTTQCIDPQCGGRGICIMGSCACNSGYKGKSCEEADCIDPGCSNHGVCIHGECHCSPGW
CG55069_08   GQYSKGRCLCFSGWKGTECDVPTTQCIDPQCGGRGICIMGSCACNSGYKGESCEEADCIDPGCSNHGVCIHGECHCSPGW 650       660       670       680       690       700       710       720
                 ....|....|....|....|....|....|....|....|....|....|....|....|....|....|....|....|
145665404    GGSNCEILKTMCPDQCSGHGTYLQESGSCTCDPNWTGPDCSNEICSVDCGSHGVCMGGTCRCEEGWTGPACNQRACHPRC
CG55069_02   GGSNCEILKTMCPDQCSGHGTYLQESGSCTCDPNWTGPDCSNEICSVDCGSHGVCMGGTCRCEEGWTGPACNQRACHPRC
CG55069_03   GGSNCEILKTMCPDQCSGHGTYLQESGSCTCDPNWTGPDCSNEICSVDCGSHGVCMGGTCRCEEGWTGPACNQRACHPRC
CG55069_08   GGSNCEILKTMCPDQCSGHGTYLQESGSCTCDPNWTGPDCSNEICSVDCGSHGVCMGGTCRCEEGWTGFTCNQRACHPRC 730       740       750       760       770       780       790       800
                 ....|....|....|....|....|....|....|....|....|....|....|....|....|....|....|....|
145665404    AEHGTCKDGKCECSQGWNGEHCTIAHYLDKIVKDKIGYKEGCPGLCNSNGRCTLDQNGGHCVCQPGWRGAGCDVAMETLC
CG55069_02   AEHGTCKDGKCECSQGWNGEHCTIAHYLDKIVKDKIGYKEGCPGLCNSNGRCTLDQNGGHCVCQPGWRGAGCDVAMETLC
CG55069_03   AEHGTCKDGKCECSQGWNGEHCTIAHYLDKIVKDKIGYKEGCPGLCNSNGRCTLDQNGGHCVCQPGWRGAGCDVAMETLC
CG55069_08   AEHGTCKDGKCECSHGWNGEHCTI--------------EGCPGLCNSNGRCTLDQNGWHCVCQPGWRGAGCDVAMETLC 810       820       830       840       850       860       870       880
                 ....|....|....|....|....|....|....|....|....|....|....|....|....|....|....|....|
145665404    TDSKDNEGDGLIDCMDPDCCLQSSCQNQPYCRGLPDPQDIISQSLQSPSQQAAKSFYDRISFLIGSDSTHVIPGESPFNK
CG55069_02   TDSKDNEGDGLIDCMDPDCCLQSSCQNQPYCRGLPDPQDIISQSLQSPSQQAAKSFYDRISFLIGSDSTHVIPGESPFNK
CG55069_03   TDSKDNEGDGLIDCMDPDCCLQSSCQNQPYCRGLPDPQDIISQSLQSPSQQAAKSFYDRISFLIGSDSTHVIPGESPFNK
CG55069_08   TDSKDNEGDGLIDCMDPDCCLQSSCQNQPYCRGLPDPQDIISQSLQSPSQQAAKSFYDRISFLIGSDSTHVIPGESPFNK 890       900       910       920       930       940       950       960
                 ....|....|....|....|....|....|....|....|....|....|....|....|....|....|....|....|
145665404    SLASVIRGQVLTADGTPLIGVNVSFFHYPEYGYTITRQDGMFDLVANGGASLTLVFERSPFLTQYHTVWIPWNVFYVMDT
CG55069_02   SLASVIRGQVLTADGTPLIGVNVSFFHYPEYGYTITRQDGMFDLVANGGASLTLVFERSPFLTQYHTVWIPWNVFYVMDT
CG55069_03   SLASVIRGQVLTADGTPLIGVNVSFFHYPEYGYTITRQDGMFDLVANGGASLTLVFERSPFLTQYHTVWIPWNVFYVMDT
CG55069_08   SLASVIRGQVLTADGTPLIGVNVSFFHYPEYGYTITRQDGMFDLVANGGASLTLVFERSPFLTQYHTVWIPWNVFYVMDT 970       980       990       1000      1010      1020      1030      1040
                 ....|....|....|....|....|....|....|....|....|....|....|....|....|....|....|....|
145665404    LVMEKEENDIPSCDLSGFVRPNPIIVSSPLSTFFRSSPEDSPIIPETQVLHEETTIPGTDLKLSYLSSRAAGYKSVLKIT
```

```
CG55069_02   LVMEKEENDIPSCDLSGFVRPNPIIVSSPLSTFFRSSPEDSPIIPETQVLHEETTIPGTDLKLSYLSSRAAGYKSVLKIT
CG55069_03   LVMEKEENDIPSCDLSGFVRPNPIIVSSPLSTFFRSSPEDSPIIPETQVLHEETTIPGTDLKLSYLSSRAAGYKSVLKIT
CG55069_08   LVMEKEENDIPSCDLSGFVRPNPIIVSSPLSTFFRSSPEDSPIIPETQVLHEETTIPGTDLKLSYLSSRAAGYKSVLKIT 1050      1060      1070      1080      1090      1100      1110      1120
               ....|....|....|....|....|....|....|....|....|....|....|....|....|....|....|....|
145665404    MTQSIIPFNLMKVHLMVAVVGRLFQKWFPASPNLAYTFIWDKTDAYNQKVYGLSEAVVSVGYEYESCLDLTLWEKRTAIL
CG55069_02   MTQSIIPFNLMKVHLMVAVVGRLFQKWFPASPNLAYTFIWDKTDAYNQKVYGLSEAVVSVGYEYESCLDLTLWEKRTAIL
CG55069_03   MTQSIIPFNLMKVHLMVAVVGRLFQKWFPASPNLAYTFIWDKTDAYNQKVYGLSEAVVSVGYEYESCLDLTLWEKRTAIL
CG55069_08   MTQSIIPFNLMKVHLMVAVVGRLFQKWFPASPNLAYTFIWDKTDAYNQKVYGLSEAVVSVGYEYESCLDLTLWEKRTAIL 1130      1140      1150      1160      1170      1180      1190      1200
               ....|....|....|....|....|....|....|....|....|....|....|....|....|....|....|....|
145665404    QGYELDASNMGGWTLDKHHVLDVQNGILYKGNENQFISQQPPVVSSIMGNGRRRSISCPSCNGQADGNKLLAPVALACG
CG55069_02   QGYELDASNMGGWTLDKHHVLDVQNGILYKGNENQFISQQPPVVSSIMGNGRRRSISCPSCNGQADGNKLLAPVALACG
CG55069_03   QGYELDASNMGGWTLDKHHVLDVQNGILYKGNENQFISQQPPVVSSIMGNGRRRSISCPSCNGQADGNKLLAPVALACG
CG55069_08   QGYELDASNMGGWTLDKHHVLDVQNGILYKGNENQFISQQPPVVSSIMGNGRRRSISCPSCNGQADGNKLLAPVALACG 1210      1220      1230      1240      1250      1260      1270      1280
               ....|....|....|....|....|....|....|....|....|....|....|....|....|....|....|....|
145665404    IDGSLYVGDFNYVRRIFPSGNVTSVLELRNKDFRHSSNPAHRYYLATDPVTGDLYVSDTNTRRIYRPKSLTGAKDLTKNA
CG55069_02   IDGSLYVGDFNYVRRIFPSGNVTSVLELRNKDFRHSSNPAHRYYLATDPVTGDLYVSDTNTRRIYRPKSLTGAKDLTKNA
CG55069_03   IDGSLYVGDFNYVRRIFPSGNVTSVLELRNKDFRHSSNPAHRYYLATDPVTGDLYVSDTNTRRIYRPKSLTGAKDLTKNA
CG55069_08   IDGSLYVGDFNYVRRIFPSGNVTSVLELRNKDFRHSSNPAHRYYLATDPVTGDLYVSDTNTRRIYRPKSLTGAKDLTKNA 1290      1300      1310      1320      1330      1340      1350      1360
               ....|....|....|....|....|....|....|....|....|....|....|....|....|....|....|....|
145665404    EVVAGTGEQCLPFDEARCGDGGKAVEATLMSPKGMAVDKNGLIYFVDGTMIRKVDQNGIISTLLGSNDLTSARPLTCDTS
CG55069_02   EVVAGTGEQCLPFDEARCGDGGKAVEATLMSPKGMAVDKNGLIYFVDGTMIRKVDQNGIISTLLGSNDLTSARPLTCDTS
CG55069_03   EVVAGTGEQCLPFDEARCGDGGKAVEATLMSPKGMAVDKNGLIYFVDGTMIRKVDQNGIISTLLGSNDLTSARPLTCDTS
CG55069_08   EVVAGTGEQCLPFDEARCGDGGKAVEATLMSPKGMAVDKNGLIYFVDGTMIRKVDQNGIISTLLGSNDLTSARPLTCDTS 1370      1380      1390      1400      1410      1420      1430      1440
               ....|....|....|....|....|....|....|....|....|....|....|....|....|....|....|....|
145665404    MHISQVRLEWPTDLAINPMDNSIYVLDNNVVLQITENRQVRIAAGRPMHCQVPGVEYPVGKHAVQTTLESATAIAVSYSG
CG55069_02   MHISQVRLEWPTDLAINPMDNSIYVLDNNVVLQITENRQVRIAAGRPMHCQVPGVEYPVGKHAVQTTLESATAIAVSYSG
CG55069_03   MHISQVRLEWPTDLAINPMDNSIYVLDNNVVLQITENRQVRIAAGRPMHCQVPGVEYPVGKHAVQTTLESATAIAVSYSG
CG55069_08   MHISQVRLEWPTDLAINPMDNSIYVLDNNVVLQITENRQVRIAAGRPMHCQVPGVEYPVGKHAVQTTLESATAIAVSYSG 1450      1460      1470      1480      1490      1500      1510      1520
               ....|....|....|....|....|....|....|....|....|....|....|....|....|....|....|....|
145665404    VLYITETDEKKINRIRQVTTDGEISLVAGIPSECDCKNDANCDCYQSGDGYAKDAKLSAPSSLAASPDGTLYIADLGNIR
CG55069_02   VLYITETDEKKINRIRQVTTDGEISLVAGIPSECDCKNDANCDCYQSGDGYAKDAKLSAPSSLAASPDGTLYIADLGNIR
CG55069_03   VLYITETDEKKINRIRQVTTDGEISLVAGIPSECDCKNDANCDCYQSGDGYAKDAKLSAPSSLAASPDGTLYIADLGNIR
CG55069_08   VLYITETDEKKINRIRQVTTDGEISLVAGIPSECDCKNDANCDCYQSGDGYAKDAKLSAPSSLAASPDGTLYIADLGNIR 1530      1540      1550      1560      1570      1580      1590      1600
               ....|....|....|....|....|....|....|....|....|....|....|....|....|....|....|....|
145665404    IRAVSKNKPLLNSMNFYEVASPTDQELYIFDINGTHQYTVSLVTGDYLYNFSYSNDNDITAVTDSNGNTLRIRRDPNRMP
CG55069_02   IRAVSKNKPLLNSMNFYEVASPTDQELYIFDINGTHQYTVSLVTGDYLYNFSYSNDNDITAVTDSNGNTLRIRRDPNRMP
CG55069_03   IRAVSKNKPLLNSMNFYEVASPTDQELYIFDINGTHQYTVSLVTGDYLYNFSYSNDNDITAVTDSNGNTLRIRRDPNRMP
CG55069_08   IRAVSKNKPLLNSMNFYEVASPTDQELYIFDINGTHQYTVSLVTGDYLYNFSYSNDNDITAVTDSNGNTLRIRRDPNRMP 1610      1620      1630      1640      1650      1660      1670      1680
               ....|....|....|....|....|....|....|....|....|....|....|....|....|....|....|....|
145665404    VRVVSPDNQVIWLTIGTNGCLKGMTAQGLELVLFTYHGNSGLLATKSDETGWTTFFDYDSEGRLTNVTFPTGVVTNLHGD
CG55069_02   VRVVSPDNQVIWLTIGTNGCLKGMTAQGLELVLFTYHGNSGLLATKSDETGWTTFFDYDSEGRLTNVTFPTGVVTNLHGD
CG55069_03   VRVVSPDNQVIWLTIGTNGCLKGMTAQGLELVLFTYHGNSGLLATKSDETGWTTFFDYDSEGRLTNVTFPTGVVTNLHGD
CG55069_08   VRVVSPDNQVIWLTIGTNGCLKGMTAQGLELVLFTYHGNSGLLATKSDETGWTTFFDYDSEGRLTNVTFPTGVVTNLHGD 1690      1700      1710      1720      1730      1740      1750      1760
               ....|....|....|....|....|....|....|....|....|....|....|....|....|....|....|....|
145665404    MDKAITVDIESSSREEDVSITSNLSSIDSFYTMVQDQLRNSYQIGYDGSLRIIYASGLDSHYQTEPHVLAGTANPTVAKR
CG55069_02   MDKAITVDIESSSREEDVSITSNLSSIDSFYTMVQDQLRNSYQIGYDGSLRIIYASGLDSHYQTEPHVLAGTANPTVAKR
CG55069_03   MDKAITVDIESSSREEDVSITSNLSSIDSFYTMVQDQLRNSYQIGYDGSLRIIYASGLDSHYQTEPHVLAGTANPTVAKR
CG55069_08   MDKAITVDIESSSREEDVSITSNLSSIDSFYTMVQDQLRNSYQIGYDGSLRIIYASGLDSHYQTEPHVLAGTANPTVAKR 1770      1780      1790      1800      1810      1820      1830      1840
               ....|....|....|....|....|....|....|....|....|....|....|....|....|....|....|....|
145665404    NMTLPGENGQNLVEWRFRKEQAQGKVNVFGRKLRVNGRNLLSVDFDRTTKTEKIYDDHRKFLLRIAYDTSGHPTLWLPSS
CG55069_02   NMTLPGENGQNLVEWRFRKEQAQGKVNVFGRKLRVNGRNLLSVDFDRTTKTEKIYDDHRKFLLRIAYDTSGHPTLWLPSS
CG55069_03   NMTLPGENGQNLVEWRFRKEQAQGKVNVFGRKLRVNGRNLLSVDFDRTTKTEKIYDDHRKFLLRIAYDTSGHPTLWLPSS
CG55069_08   NMTLPGENGQNLVEWRFRKEQAQGKVNVFGRKLRVNGRNLLSVDFDRTTKTEKIYDDHRKFLLRIAYDTSGHPTLWLPSS 1850      1860      1870      1880      1890      1900      1910      1920
               ....|....|....|....|....|....|....|....|....|....|....|....|....|....|....|....|
145665404    KLMAVNVTYSSTGQIASIQRGTTSEKVDYDGQGRIVSRVFADGKTWSYTYLEKSMVLLLHSQRQYIFEYDMWDRLSAITM
CG55069_02   KLMAVNVTYSSTGQIASIQRGTTSEKVDYDGQGRIVSRVFADGKTWSYTYLEKSMVLLLHSQRQYIFEYDMWDRLSAITM
CG55069_03   KLMAVNVTYSSTGQIASIQRGTTSEKVDYDGQGRIVSRVFADGKTWSYTYLEKSMVLLLHSQRQYIFEYDMWDRLSAITM
CG55069_08   KLMAVNVTYSSTGQIASIQRGTTSEKVDYDGQGRIVSRVFADGKTWSYTYLEKSMVLLLHSQRQYIFEYDMWDRLSAITM 1930      1940      1950      1960      1970      1980      1990      2000
               ....|....|....|....|....|....|....|....|....|....|....|....|....|....|....|....|
```

| | |
|---|---|
| 145665404 | PSVARHTMQTIRSIGYYRNIYNPPESNASIITDYNEEGLLLQTAFLGTSRRVLFKYRRQTRLSEILYDSTRVSFTYDETA |
| CG55069_02 | PSVARHTMQTIRSIGYYRNIYNPPESNASIITDYNEEGLLLQTAFLGTSRRVLFKYRRQTRLSEILYDSTRVSFTYDETA |
| CG55069_03 | PSVARHTMQTIRSIGYYRNIYNPPESNASIITDYNEEGLLLQTAFLGTSRRVLFKYRRQTRLSEILYDSTRVSFTYDETA |
| CG55069_08 | PSVARHTMQTIRSIGYYRNIYNPPESNASIITDYNEEGLLLQTAFLGTSRRVLFKYRRQTRLSEILYDSTRVSFTYDETA |

```
              2010      2020      2030      2040      2050      2060      2070      2080
         ....|....|....|....|....|....|....|....|....|....|....|....|....|....|....|....|
145665404   GVLKTVNLQSDGFICTIRYRQIGPLIDRQIFRFSEDGMVNARFDYSYDNSFRVTSMQGVINETPLPIDLYQFDDISGKVE
CG55069_02  GVLKTVNLQSDGFICTIRYRQIGPLIDRQIFRFSEDGMVNARFDYSYDNSFRVTSMQGVINETPLPIDLYQFDDISGKVE
CG55069_03  GVLKTVNLQSDGFICTIRYRQIGPLIDRQIFRFSEDGMVNARFDYSYDNSFRVTSMQGVINETPLPIDLYQFDDISGKVE
CG55069_08  GVLKTVNLQSDGFICTIRYRQIGPLIDRQIFRFSEDGMVNARFDYSYDNSFRVTSMQGVINETPLPIDLYQFDDISGKVE 2090      2100      2110      2120      2130      2140      2150      2160
         ....|....|....|....|....|....|....|....|....|....|....|....|....|....|....|....|
145665404   QFGKFGVIYYDINQIISTAVMTYTKHFDAHGRIKEIQYEIFRSLMYWITIQYDNMGRVTKREIKIGPFANTTKYAYEYDV
CG55069_02  QFGKFGVIYYDINQIISTAVMTYTKHEDAHGRIKEIQYEIFRSLMYWITIQYDNMGRVTKREIKIGPFANTTKYAYEYDV
CG55069_03  QFGKFGVIYYDINQIISTAVMTYTKHFDAHGRIKEIQYEIFRSLMYWITIQYDNMGRVTKREIKIGPFANTTKYAYEYDV
CG55069_08  QFGKFGVIYYDINQIISTAVMTYTKHFDAHGRIKEIQYEIFRSLMYWITIQYDNMGRVTKREIKIGPFANTTKYAYEYDV 2170      2180      2190      2200      2210      2220      2230      2240
         ....|....|....|....|....|....|....|....|....|....|....|....|....|....|....|....|
145665404   DGQLQTVYLNEKIMWRYNYDLNGNLHLLNPSNSARLTPLRYDLRDRITRLGDVQYRLDEDGFLRQRGTEIFEYSSKGLLT
CG55069_02  DGQLQTVYLNEKIMWRYNYDLNGNLHLLNPSNSARLTPLRYDLRDRITRLGDVQYRLDEDGFLRQRGTEIFEYSSKGLLT
CG55069_03  DGQLQTVYLNEKIMWRYNYDLNGNLHLLNPSNSARLTPLRYDLRDRITRLGDVQYRLDEDGFLRQRGTEIFEYSSKGLLT
CG55069_08  DGQLQTVYLNEKIMWRYNYDLNGNLHLLNPSNSARLTPLRYDLRDRITRLGDVQYRLDEDGFLRQRGTEIFEYSSKGLLT 2250      2260      2270      2280      2290      2300      2310      2320
         ....|....|....|....|....|....|....|....|....|....|....|....|....|....|....|....|
145665404   RVYSKGSGWTVIYRYDGLGRRVSSKTSLGQHLQFFYADLTYPTRITHVYNHSSSEITSLYYDLQGHLFAMEISSGDEFYI
CG55069_02  RVYSKGSGWTVIYRYDGLGRRVSSKTSLGQHLQFFYADLTYPTRITHVYNHSSSEITSLYYDLQGHLFAMEISSGDEFYI
CG55069_03  RVYSKGSGWTVIYRYDGLGRRVSSKTSLGQHLQFFYADLTYPTRITHVYNHSSSEITSLYYDLQGHLFAMEISSGDEFYI
CG55069_08  RVYSKGSGWTVIYRYDGLGRRVSSKTSLGQHLQFFYADLTYPTRITHVYNHSSSEITSLYYDLQGHLFAMEISSGDEFYI 2330      2340      2350      2360      2370      2380      2390      2400
         ....|....|....|....|....|....|....|....|....|....|....|....|....|....|....|....|
145665404   ASDNTGTPLAVFSSNGLMLKQIQYTAYGEIYFDSNIDFQLVIGFHGGLYDPLTKLIHFGERDYDILAGRWTTPDIEIWKR
CG55069_02  ASDNTGTPLAVFSSNGLMLKQIQYTAYGEIYFDSNIDFQLVIGFHGGLYDPLTKLIHFGERDYDILAGRWTTPDIEIWKR
CG55069_03  ASDNTGTPLAVFSSNGLMLKQIQYTAYGEIYFDSNIDFQLVIGFHGGLYDPLTKLIHFGERDYDILAGRWTTPDIEIWKR
CG55069_08  ASDNTGTPLAVFSSNGLMLKQIQYTAYGEIYFDSNIDFQLVIGFHGGLYDPLTKLIHFGERDYDILAGRWTTPDIEIWKR 2410      2420      2430      2440      2450      2460      2470      2480
         ....|....|....|....|....|....|....|....|....|....|....|....|....|....|....|....|
145665404   IGKDPAPFNLYMFRNNNPASKIHDVKDYITDVNSWLVTFGFHLHNAIPGFPVPKFDLTEPSYELVKSQQWDDIPPIFGVQ
CG55069_02  IGKDPAPFNLYMFRNNNPASKIHDVKDYITDVNSWLVTFGFHLHNAIPGFPVPKFDLTEPSYELVKSQQWDDIPPIFGVQ
CG55069_03  IGKDPAPFNLYMFRNNNPASKIHDVKDYITDVNSWLVTFGFHLHNAIPGFPVPKFDLTEPSYELVKSQQWDDIPPIFGVQ
CG55069_08  IGKDPAPFNLYMFRNNNPASKIHDVKDYITDVNSWLVTFGFHLHNAIPGFPVPKFDLTEPSYELVKSQQWDDIPPIFGVQ 2490      2500      2510      2520      2530      2540      2550      2560
         ....|....|....|....|....|....|....|....|....|....|....|....|....|....|....|....|
145665404   QQVARQAKAFLSLGKMAEVQVSRRRAGGAQSWLWFATVKSLIGKGVMLAVSQGRVQTNVLNIANEDCIKVAAVLNNAFYL
CG55069_02  QQVARQAKAFLSLGKMAEVQVSRRRAGGAQSWLWFATVKSLIGKGVMLAVSQGRVQTNVLNIANEDCIKVAAVLNNAFYL
CG55069_03  QQVARQAKAFLSLGKMAEVQVSRRRAGGAQSWLWFATVKSLICKGVMLAVSQGRVQTNVLNIANEDCIKVAAVLNNAFYL
CG55069_08  QQVARQAKAFLSLGKMAEVQVSRRRAGGAQSWLWFATVKSLIGKGVMLAVSQGRVQTNVLNIANEDCIKVAAVLNNAFYL 2570      2580      2590      2600      2610      2620      2630      2640
         ....|....|....|....|....|....|....|....|....|....|....|....|....|....|....|....|
145665404   ENLHFTIEGKDTHYFIKTTTPESDLGTLRLTSGRKALENGINVTVSQSTTVVNGRTRRFADVEMQFGALALHVRYGMTLD
CG55069_02  ENLHFTIEGKDTHYFIKTTTPESDLGTLRLTSGRKALENGINVTVSQSTTVVNGRTRRFADVEMQFGALALHVRYGMTLD
CG55069_03  ENLHFTIEGKDTHYFIKTTTPESDLGTLRLTSGRKALENGINVTVSQSTTVVNGRTRRFADVEMQFGALALHVRYGMTLD
CG55069_08  ENLHFTIEGKDTHYFIKTTTPESDLGTLRLTSGRKALENGINVTVSQSTTVVNGRTRRFADVEMQFGALALHVRYGMTLD 2650      2660      2670      2680      2690      2700      2710      2720
         ....|....|....|....|....|....|....|....|....|....|....|....|....|....|....|....|
145665404   EEKARILEQARQRALARAWAREQQRVRDGEEGARLWTEGEKRQLLSAGKVQGYDGYYVLSVEQYPELADSANNIQFLRQS
CG55069_02  EEKARILEQARQRALARAWAREQQRVRDGEEGARLWTEGEKRQLLSAGKVQGYDGYYVLSVEQYPELADSANNIQFLRQS
CG55069_03  EEKARILEQARQRALARAWAREQQRVRDGEEGARLWTEGEKRQLLSAGKVQGYDGYYVLSVEQYPELADSANNIQFLRQS
CG55069_08  EEKARILEQARQRALARAWAREQQRVRDGEEGARLWTEGEKRQLLSAGKVQGYDGYYVLSVEQYPELADSANNIQFLRQS

....|
145665404   EIGRR    (SEQ ID NO:36)
CG55069_02  EIGRR    (SEQ ID NO:38)
CG55069_03  EIGRR    (SEQ ID NO:40)
CG55069_08  EIGRR    (SEQ ID NO:42)
```

In a search of public sequence databases, NOV15a was found to have homology to the amino acid sequences shown in the BLASTP data listed in Table 15J.

TABLE 15J

BLASTP results for NOV15a

| Gene Index/Identifier | Protein/Organism | Length (aa) | Identity (%) | Positives (%) | Expect |
|---|---|---|---|---|---|
| ptnr:SPTREMBL-ACO:Q9WTS6 | TEN-M3 - *Mus musculus* | 2715 | 2663/2725 (97%) | 2696/2725 (98%) | 0.0 |
| ptnr:SPTREMBL-ACC:Q9W7R4 | TEN-M3 - *Brachydanio rerio* (Zebrafish) (Zebra danio) | 2590 | 2004/2579 (77%) | 2255/2579 (87%) | 0.0 |
| ptnr:SPTREMBL-ACC:Q9JLC1 | ODZ3 - *Mus musculus* | 2346 | 2015/2182 (92%) | 2053/2182 (94%) | 0.0 |
| ptnr:SPTREMBL-ACC:Q9WTS7 | TEN-M4 - *Mus musculus* | 2771 | 1752/2637 (66%) | 2098/2637 (79%) | 0.0 |
| ptnr:SPTREMBL-ACC:Q9P273 | KIAA1455 PROTEIN - *Homo sapiens* | 1769 | 1767/1769 (99%) | 1768/1769 (99%) | 0.0 |

Other BLAST results include sequences from the Patp database, which is a proprietary database that contains sequences published in patents and patent publications. Patp results include those listed in Table 15K.

TABLE 15K

Patp BLASTP Analysis for NOV15a

| Sequences producing High-scoring Segment Pairs | Protein/Organism | Length (aa) | Identity (%) | Positive (%) | E Value |
|---|---|---|---|---|---|
| patp:AAM78695 | Human protein SEQ ID NO 1357 - *Homo sapiens* | 2136 | 1255/2137 (58%) | 1625/2137 (76%) | 0.0 |
| patp:AAB92858 | Human protein sequence SEQ ID NO:11431 - *Homo sapiens* | 1045 | 1045/1045 (100%) | 1045/1045 (100%) | 0.0 |
| patp:AAB93294 | Human protein sequence SEQ ID NO:12355 - *Homo sapiens* | 964 | 964/964 (100%) | 964/964 (100%) | 0.0 |
| patp:AAB92780 | Human protein sequence SEQ ID NO:11266 - *Homo sapiens* | 625 | 625/625 (100%) | 625/625 (100%) | 0.0 |
| patp:AAM79679 | Human protein SEQ ID NO 3325 - *Homo sapiens* | 1015 | 569/1009 (56%) | 741/1009 (73%) | 2.6e-308 |

Table 15L lists the domain description from DOMAIN analysis results against NOV15a.

| Table 15L. Domain Analysis of NOV15a | | | | | | |
|---|---|---|---|---|---|---|
| Pfam analysis | | | | | | |
| Model | Domain | seq-f seq-t | hmm-f hmm-t | | score | E-value |

```
--------        -------  -----  -----      -----  -----     -----    -------
EGF             1/7      522    548  ..    1      45  []    12.8     1.6
EGF             2/7      586    613  ..    1      45  []    16.5     0.63
EGF             3/7      618    645  ..    1      45  []    19.3     0.093
TIL             1/1      604    652  ..    1      67  []    -15.5    9.9
EGF             4/7      652    680  ..    1      45  []    13.3     1.4
EGF             5/7      685    711  ..    1      45  []    12.2     1.8
EGF             6/7      716    742  ..    1      45  []    21.3     0.023
EGF             7/7      762    792  ..    1      45  []    14.5     1.1
ATHILA          1/1      1217   1234 ..    355    372 ..    3.2      2.1
NHL             1/2      1368   1395 ..    1      30  []    9.8      1.7
NHL             2/2      1497   1524 ..    1      30  []    10.5     1.3
Glyco_hydro_38  1/1      1845   1870 ..    688    715 .]    4.3      1.3
```

Alignments of top-scoring domains:
 EGF: domain 1 of 7, from 522 to 548: score 12.8, E = 1.6
 (SEQ ID NO:182)          CapnnpCsngGtCvntpggssdnfggytCeCppGdyylsytGkrC<-
                                       |+    +|+++|+||++
||+| ||      +  |++|
   NOV15a    (SEQ ID NO:373) 522    CPR--NCHGNGECVSG-----------TCHCFPG-----
FLGPDC   548

EGF: domain 2 of 7, from 586 to 613: score 16.5, E = 0.63
 (SEQ ID NO:183)          CapnnpCsngGtCvntpggssdnfggytCeCppGdyylsytGkrC<-
                                       | ++  |  ++|+|++ +           +|
| |    | |+ |
   NOV15a    (SEQ ID NO:374) 586    CIDP-QCGGRGICIMG-----------SCACSSG-----
YKGESC   613

EGF: domain 3 of 7, from 618 to 645: score 19.3, E = 0.093
 (SEQ ID NO:184)          CapnnpCsngGtCvntpggssdnfggytCeCppGdyylsytGkrC<-
                                       | ++ +|||+|+|+ +
+|+| ||     + | +|
   NOV15a    (SEQ ID NO:375) 618    CIDP-GCSNHGVCIHG-----------ECHCSPG-----
WGGSNC   645

TIL: domain 1 of 1, from 604 to 652: score -15.5, E = 9.9
 (SEQ ID NO:185)          CpaneqyteCgpsCepsCsnpdgplettppCegtSpkvPstCkeg.C
                                       |     +|      |+   | +|
|     + +|+  |+|
   NOV15a    (SEQ ID NO:376) 604    CSSGYKGESCE---EADCIDPG--------CS-----
NHGVCIHGeC 634 vCqpGyVrnndgdkCVprseC<-*
                         |+||   +|  +   ++++ |
                   635 HCSPGWGGSNCE---ILKTMC    652

EGF: domain 4 of 7, from 652 to 680: score 13.3, E = 1.4
 (SEQ ID NO:186)          CapnnpCsngGtCvntpggssdnfggytCeCppGdyylsytGkrC<-
                                       |++   ||++|| +     |
+|+| |     +||++|
   NOV15a    (SEQ ID NO:377) 652    CPD--QCSGHGTYLQESG---------SCTCDPN-----
WTGPDC   680

EGF: domain 5 of 7, from 685 to 711: score 12.2, E = 1.8
 (SEQ ID NO:187)          CapnnpCsngGtCvntpggssdnfggytCeCppGdyylsytGkrC<-
                                       |+    |  +|+|++ +
||+| +|    +||+ |
   NOV15a    (SEQ ID NO:378) 685    CSV--DCGSHGVCMGG-----------TCRCEEG-----
WTGPAC   711

```
     EGF: domain 6 of 7, from 716 to 742: score 21.3, E = 0.023
  (SEQ ID NO:188)              CapnnpCsngGtCvntpggssdnfggytCeCppGdyylsytGkrC<-
                                        |+|    |  ++|||  ++
+|||  +|     ++|++|
     NOV15a    (SEQ ID NO:379) 716   CHP--RCAEHGTCKDG----------KCECSQG-----
WNGEHC    742

EGF: domain 7 of 7, from 762 to 792: score 14.5, E = 1.1
  (SEQ ID NO:189)              CapnnpCsngGtCvntpggssdnfggytCeCppGdyylsytGkrC<-
                                        |+     |+ +|+|+    +         |
+|+|+||    +  |  |
     NOV15a    (SEQ ID NO:380) 762   CPG--LCNSNGRCTLDQN-------GGHCVCQPG-----
WRGAGC    792

ATHILA: domain 1 of 1, from 1217 to 1234: score 3.2, E = 2.1
  (SEQ ID NO:190)              LPceevTsIierdnIdFk<-*
                                        +|+ +|||++| +|+||+
     NOV15a    (SEQ ID NO:381) 1217  FPSGNVTSVLELRNKDFR     1234

NHL: domain 1 of 2, from 1368 to 1395: score 9.8, E = 1.7
  (SEQ ID NO:191)              fdrPrGvavdpsdGqivVaDqsenhriqvF<-*
                                       + +|+++|++|  |+ |+|  |   +|
+|+
     NOV15a    (SEQ ID NO:382) 1368  LEWPTDLAINPMDNSIYVLD--NNVVLQIT     1395

NHL: domain 2 of 2, from 1497 to 1524: score 10.5, E = 1.3
  (SEQ ID NO:192)              fdrPrGvavdpsdGqivVaDqsenhriqvF<-*
                                       +  | ++|+ +||  +++||   +|  ||
     NOV15a    (SEQ ID NO:383) 1497  LSAPSSLAAS-PDGTLYIAD-LGNIRIRAV     1524

Glyco_hydro_38: domain 1 of 1, from 1845 to 1870: score 4.3, E = 1.3
  (SEQ ID NO:193)              lkveFdeletGllksitrkqdnktvhvn<-*
                                       ++|   ++    ||  ++||+|  ++    +|+++
     NOV15a    (SEQ ID NO:384) 1845  VNVTYS--STGQIASIQRGTTSEKVDYD     1870
```

In a search of public sequence databases, NOV15d was found to have homology to the amino acid sequences shown in the BLASTP data listed in Table 15M.

TABLE 15M

BLASTP results for NOV15d

| Gene Index/ Identifier | Protein/Organism | Length (aa) | Identity (%) | Positives (%) | Expect |
|---|---|---|---|---|---|
| ptnr:SPTREMBL-ACC:Q9WTS6 | TEN-M3 - *Mus musculus* | 2715 | 2496/2568 (97%) | 2527/2568 (98%) | 0.0 |
| ptnr:SPTREMBL-ACC:Q9JLC1 | ODZ3 - *Mus musculus* | 2346 | 2309/2353 (98%) | 2334/2353 (99%) | 0.0 |
| ptnr:SPTREMBL-ACC:Q9W7R4 | TEN-M3 - *Brachydanio rerio* (Zebrafish) (Zebra danio) | 2590 | 2117/2576 (82%) | 2352/2576 (91%) | 0.0 |
| ptnr:SPTREMBL-ACC:Q9R1K2 | NEURESTIN ALPHA - *Rattus norvegicus* | 2765 | 1783/2534 (70%) | 2135/2534 (84%) | 0.0 |
| ptnr:SPTREMBL-ACC:Q9DER5 | TENEURIN-2 - *Gallus gallus* | 2802 | 1779/2536 (70%) | 2143/2536 (84%) | 0.0 |

Other BLAST results include sequences from the Patp database, which is a proprietary database that contains sequences published in patents and patent publications. Patp results include those listed in Table 15N.

TABLE 15N

Patp BLASTP Analysis for NOV15

| Sequences producing High-scoring Segment Pairs | Protein/Organism | Length (aa) | Identity (%) | Positive (%) | E Value |
|---|---|---|---|---|---|
| patp:AAM78695 | Human protein SEQ ID NO 1357 - *Homo sapiens* | 2136 | 1185/1962 (60%) | 1521/1962 (77%) | 0.0 |
| patp:AAB92858 | Human protein sequence SEQ ID NO:11431 - *Homo sapiens* | 1045 | 1045/1045 (100%) | 1045/1045 (100%) | 0.0 |
| patp:AAB93294 | Human protein sequence SEQ ID NO:12355 - *Homo sapiens* | 964 | 964/964 (100%) | 964/964 (100%) | 0.0 |
| patp:AAB92780 | Human protein sequence SEQ ID NO:11266 - *Homo sapiens* | 625 | 625/625 (100%) | 625/625 (100%) | 0.0 |
| patp:AAM79679 | Human protein SEQ ID NO 3325 - *Homo sapiens* | 1015 | 569/1009 (56%) | 741/1009 (73%) | 2.6e-308 |

Table 15O lists the domain description from DOMAIN analysis results against NOV15d.

Table 15O. Domain Analysis of NOV15d

```
Pfam analysis
    Model          Domain   seq-f  seq-t    hmm-f  hmm-t      score    E-value
    ---------      ------   -----  -----    -----  -----      -----    -------
    EGF            1/7      425    451   ..   1     45  []     12.8     1.6
    EGF            2/7      489    516   ..   1     45  []     14.8     1
    EGF            3/7      521    548   ..   1     45  []     19.3     0.093
    EGF            4/7      555    583   ..   1     45  []     13.3     1.4
    EGF            5/7      588    614   ..   1     45  []     14.1     1.2
    EGF            6/7      619    645   ..   1     45  []     21.0     0.027
    EGF            7/7      650    680   ..   1     45  []     17.2     0.38
    ATHILA         1/1      1105   1122  ..   355   372 ..      3.2     2.1
    NHL            1/2      1256   1283  ..   1     30  []      9.8     1.7
    NHL            2/2      1385   1412  ..   1     30  []     10.5     1.3
    Glyco_hydro_38 1/1      1733   1758  ..   688   715 .]      4.3     1.3

Alignments of top-scoring domains:
    EGF: domain 1 of 7, from 425 to 451: score 12.8, E = 1.6
 (SEQ ID NO:196)              CapnnpCsngGtCvntpggssdnfggytCeCppGdyylsytGkrC<-
                                           |+    +|+++|+||++
 ||+| ||       + |++|
    NOV15d     (SEQ ID NO:385) 425   CPR--NCHGNGECVSG-----------TCHCFPG-----
FLGPDC    451

EGF: domain 2 of 7, from 489 to 516: score 14.8, E = 1
 (SEQ ID NO:197)              CapnnpCsngGtCvntpggssdnfggytCeCppGdyylsytGkrC<-
                                           | ++   | ++|+|+ +          +|
```

```
      |   |    |  |+ |
         NOV15d    (SEQ ID NO:386) 489    CIDP-QCGGRGICIMG----------SCACNSG-----
YKGESC    516

EGF: domain 3 of 7, from 521 to 548: score 19.3, E = 0.093
   (SEQ ID NO:198)              CapnnpCsngGtCvntpggssdnfggytCeCppGdyylsytGkrC<-
                                                      |  ++ +|||+|+|+ +
+|+| ||      + | +|
         NOV15d    (SEQ ID NO:387) 521    CIDP-GCSNHGVCIHG----------ECHCSPG-----
WGGSNC    548

EGF: domain 4 of 7, from 555 to 583: score 13.3, E = 1.4
   (SEQ ID NO:199)              CapnnpCsngGtCvntpggssdnfggytCeCppGdyylsytGkrC<-
                                                      |++   ||++|| +   |
+|+| |      +||++|
         NOV15d    (SEQ ID NO:388) 555    CPD--QCSGHGTYLQESG---------SCTCDPN-----
WTGPDC    583

EGF: domain 5 of 7, from 588 to 614: score 14.1, E = 1.2
   (SEQ ID NO:200)              CapnnpCsngGtCvntpggssdnfggytCeCppGdyylsytGkrC<-
                                                      |+   |  +|+|+ +
||+| +|      +||++|        NOV15d    (SEQ ID NO:389) 588     CSV--
DCGSHGVCMGG-----------TCRCEEG-----WTGPTC    614

EGF: domain 6 of 7, from 619 to 645: score 21.0, E = 0.027
   (SEQ ID NO:201)              CapnnpCsngGtCvntpggssdnfggytCeCppGdyylsytGkrC<-
                                                      |+|   |  ++||| ++
+||| +|     ++|++|
         NOV15d    (SEQ ID NO:390) 619    CHP--RCAEHGTCKDG----------KCECSHG-----
WNGEHC    645

EGF: domain 7 of 7, from 650 to 680: score 17.2, E = 0.38
   (SEQ ID NO:202)              CapnnpCsngGtCvntpggssdnfggytCeCppGdyylsytGkrC<-
                                                      |+    |+ +|+|+   +     |
+|+|+||      + | |
         NOV15d    (SEQ ID NO:391) 650    CPG--LCNSNGRCTLDQN-------GWHCVCQPG-----
WRGAGC    680

ATHILA: domain 1 of 1, from 1105 to 1122: score 3.2, E = 2.1
   (SEQ ID NO:203)              LPceevTsIierdnIdFk<-*
                                    +|+ +|||++| +|+||+
         NOV15d    (SEQ ID NO:392) 1105    FPSGNVTSVLELRNKDFR    1122

NHL: domain 1 of 2, from 1256 to 1283: score 9.8, E = 1.7
   (SEQ ID NO:204)              fdrPrGvavdpsdGqivVaDqsenhriqvF<-*
                                  + +|+++|++|  |+ |+| |   +|
+|+
         NOV15d    (SEQ ID NO:393) 1256    LEWPTDLAINPMDNSIYVLD--NNVVLQIT    1283

NHL: domain 2 of 2, from 1385 to 1412: score 10.5, E = 1.3
   (SEQ ID NO:205)              fdrPrGvavdpsdGqivVaDqsenhriqvF<-*
                                  +  |  ++|+  +|| +++||   +|  ||
         NOV15d    (SEQ ID NO:394) 1385    LSAPSSLAAS-PDGTLYIAD-LGNIRIRAV    1412

Glyco_hydro_38: domain 1 of 1, from 1733 to 1758: score 4.3, E = 1.3
   (SEQ ID NO:206)              lkveFdeletGllksitrkqdnktvhvn<-*
                                  ++|  ++   ||  ++|+|+  ++  +|+++
         NOV15d    (SEQ ID NO:395) 1733    VNVTYS--STGQIASIQRGTTSEKVDYD    1758
```

EGF-like domain (IPR000561): A sequence of about thirty to forty amino-acid residues long found in the sequence of epidermal growth factor (EGF) has been shown to be present, in a more or less conserved form, in a large number of other, mostly animal proteins. The list of proteins currently known to contain one or more copies of an EGF-like pattern is large and varied. The functional significance of EGF domains in what appear to be unrelated proteins is not yet clear. However, a common feature is that these repeats are found in the extracellular domain of membrane-bound proteins or in proteins known to be secreted (exception: prostaglandin G/H synthase). The EGF domain includes six cysteine residues which have been shown (in EGF) to be involved in disulfide bonds. The main structure is a two-stranded beta-sheet followed by a loop to a C-terminal short two-stranded sheet. Subdomains between the conserved cysteines vary in length. (Campbell I. D., Bork P., 1993, Curr. Opin. Struct. Biol. 3: 385–392; Weber I. T., Appella E., Blasi F., 1988, FEBS Lett. 231: 1–4; Doolittle R. F., Feng D. F., Johnson M. S., 1984, Nature 307: 558–560; Davis C. G., 1990, New Biol. 2: 410–419; Hunt L. T., Barker W. C., Blomquist M. C., 1984, Proc. Natl. Acad. Sci. U.S.A. 81: 7363–7367; Hunt L. T., Barker W. C., George D. G., Johnson G. C., 1986, Protein Nucleic Acid Enz. 29: 54–68).

This indicates that the sequence of the invention has properties similar to those of other proteins known to contain this/these domain(s) and similar to the properties of these domains.

The establishment of periodic patterns during the development of the *Drosophila* embryo is controlled by genes that act in a hierarchical manner (Nüsslein-Volhard and Wieschhaus, 1980, Nature 287: 795–801; Ingham 1988, Nature 335: 25–34; St. Johnston and Nüsslein-Volhard, 1992, Cell 68: 201–219). Maternal activities induce the expression of transcription factors, encoded by gap genes, which regulate the expression of other transcription factors encoded by pair rule genes. Pair rule genes are expressed in seven stripes along the anterior-posterior axis of *Drosophila melanogaster*. Their expression is crucial for the consecutive expression of segment polarity genes and the establishment of the segmental pattern of *Drosophila* embryos. Mutations in pair rule genes result in deletions of cuticle segments which appear in a reiterative manner along the body axis of the hatched larvae. All known pair rule genes code for transcription factors, except for a gene identified independently in two laboratories and designated ten-m (Baumgartner et al., 1994, EMBO J. 13: 3728–3740) and odz (Levine et al., 1994, EMBO J. 13: 3728–3740). ten-m and odz are identical genes and mutations lead to a pair rule phenotype similar to odd-paired in which every other segment is missing (Nüsslein-Volhard et al., 1995, Cold Spring Harb. Symp. Quant. Biol. 50: 145–154). Despite the fact that both reports showed identical sequences, Ten-m was described as a secreted *Drosophila* tenascin-like molecule and Odz as a type I transmembrane receptor. Tenascins are a family of extracellular matrix proteins with a modular structure composed of fibronectin type III (FNIII) repeats, EGF-like repeats, and a COOH-terminal fibrinogen-like repeat (Erickson, 1993, Curr. Opin. Cell Biol. 5: 869–876). Biochemical studies using a *Drosophila* cell line indicated that Ten-m is a large secreted proteoglycan with chondroitinase ABC-sensitive chondroitin sulfate and/or dermatan sulfate side chains. The core protein was reported to contain EGF-like and FNIII repeats, but to lack the fibrinogen-like domain (Baumgartner et al., 1994, EMBO J. 13: 3728–3740). Odz was isolated as a novel phosphotyrosine-containing protein (Levine et al., 1994, Cell 77: 587–598). A transmembrane region was predicted COOH-terminal of the EGF repeats, followed by the cytoplasmic domain containing several tyrosine kinase phosphorylation consensus sites. More recently, Wang et al. (1998, EMBO J. 17: 3619–3630) described a mammalian orthologue of Ten-m/Odz, termed DOC4 (downstream of chop), which is induced by the stress-induced transcription factor CHOP. The open reading frame of DOC4 shares 31% sequence identity and 50% sequence similarity with Ten-m/Odz. Furthermore, DOC4 contains a short stretch of hydrophobic amino acids ~400 amino acids COOH-terminal of the putative start codon. This together with the cell surface localization led to the suggestion that DOC4 may constitute a type II transmembrane molecule. Ten-m/Odz, as well as DOC4, contains a stretch of eight consecutive EGF-like modules which are most similar to the EGF repeats of tenascins. EGF modules are structural units of proteins or parts of protein, located extracellularly. They can occur as isolated modules such as in reelin (D'Arcangelo et al., 1995, Nature. 374: 719–723) and in selectins (Whelan, 1996, Trends Biochem. Sci. 21: 65–69), or in arrays like in notch (Fleming et al., 1997, Development. 124: 2973–2981) and tenascins (Spring et al., 1989, Cell. 59: 325–334). A conserved feature of the EGF domain in Ten-m/Odz, DOC4, and Ten-a, a *Drosophila* molecule related to Ten-m/Odz (Baumgartner and Chiquet-Ehrismann, 1993, Mech. Dev. 40: 165–176), is the substitution of a cysteine residue with an aromatic amino acid in two of the eight EGF-like modules. This leaves two cysteines with no intramodular partner. The importance of the integrity of the cysteine patterns in EGF-like modules is exemplified by the functional impairment of notch 3, which has been observed in patients with an autosomal dominant disorder causing stroke (Joutel et al., 1997, Lancet. 350: 1511–1515). The molecular basis of this disease is predominantly the substitution of cysteines with other amino acids in the EGF modules of notch 3. The observation that the EGF-like modules of Ten-m/Odz with five cysteines are ontogenetically conserved indicates that they are able to fold into a structure which might be important for the function of the protein.

Many genes that control pattern formation are expressed at several different periods during development to function in a variety of processes both during embryogenesis and postnatal life. After the initial expression in seven stripes at the cellular blastoderm stage, ten-m/odz is downregulated and appears at later stages in the central nervous system (CNS), dorsal vessel, trachea, and the eye and discs giving rise to the cephalic (antenna), ventral (wing), and dorsal (legs) thoracic appendages (Baumgartner et al., 1994, EMBO J. 13: 3728–3740; Levine et al., 1994, EMBO J. 13: 3728–3740). The highest level of Ten-m/Odz expression is observed in the CNS where the protein is deposited on the surface of axons (Levine et al., 1997, Dev. Dyn. 209: 1–14). The *Drosophila* eye disk is another location where high levels of Ten-m/Odz are found in very distinct sites including the morphogenetic furrow, photoreceptor-like cells, and nonepithelial cells of the eye disc (Levine et al., 1997, Dev. Dyn. 209: 1–14). The expression pattern of DOC4 in mammals is not well characterized but the presence of the mRNA has been demonstrated in the developing mouse brain (Wang et al., 1998, EMBO J. 17: 3619–3630).

Several mutations in the ten-m/odz gene have been identified, all resulting in embryonic lethality (Baumgartner et al., 1994, EMBO J. 13: 3728–3740; Levine et al., 1994, EMBO J. 13: 3728–3740). Due to the lack of viable hypomorphic mutations, it is not clear whether the protein executes an important function in all sites where it is expressed. One possible function for Ten-m/Odz comes from studies with DOC4 which has been isolated in search of GADD153/CHOP (growth arrest and DNA damage/C/EBP homology protein)-induced mRNA. GADD153/CHOP is responsive to many forms of stress, including alkylating agents, UV light, and conditions that trigger an ER stress response. For example, ER stress which occurs during ischemia alters proliferation of cells, induces cell death, and the expression of GADD153/CHOP (Zinszner et al., 1998, Genes Dev. 12: 982–995). Recent studies have shown that GADD153/CHOP exerts at least part of its function via the induction of DOC4 and other proteins (Wang et al., 1998, EMBO J. 17: 3619–3630).

Recently, Oohashi et al. (1999, J. Cell Biol. 145: 563–577) have shown that at least four different cDNAs with similarity to the *Drosophila* ten-m/odz cDNA are expressed in mice. One of them, ten-m4, is identical to the DOC4 cDNA. The alignment of the four deduced mouse protein sequences indicated a strong conservation of the characteristic features for type II transmembrane molecules, which was also recognized for DOC4. In addition, the recombinant production of the putative extracellular domain of Ten-ml revealed the formation of dimeric structures. The dimerization of Ten-mI is mediated via the single cysteine residues in the EGF modules that lack their intramodular partners. Also, Ten-ml is able to make homophilic interactions.

CD79 alpha is a subunit of an intracytoplasmic protein reported to be specific for B lymphocytes, including immature B lineage cells. To evaluate expression of the CD79 alpha antigen in acute myeloid leukemia (AML), we studied forty-eight cases of AML by paraffin section immunohistochemistry. The cases included four M0, nine M1, nine M2, ten M3, ten M4, and six M5 AMLs using criteria of the French-American-British cooperative group. Eleven cases demonstrated cytoplasmic staining for the CD79 alpha antigen, including one M1, nine M3, and one M5 AML. These CD79 alpha-positive cases represented 5% of all non-promyelocytic AMLs and 90% of all acute promyelocytic leukemias studied. All acute promyelocytic leukemias had the characteristic t(15;17)(q24;q21), including two cases of the microgranular variant (M3v). No other B-lineage-associated antigens were found in the CD79 alpha-positive cases, with the exception of a subpopulation of CD19-positive leukemic cells in one patient. The two non-promyelocytic leukemias that expressed CD79 alpha had no evidence of t(15;17) and did not express any additional B-lineage-associated antigens that might suggest a mixed lineage proliferation. This study demonstrates that CD79 alpha expression in acute leukemia is not restricted to B-lineage acute lymphoblastic leukemias and that CD79 alpha expression is frequently associated with t(15;17) acute myeloid leukemia.

NOV16

NOV16 includes five novel Aldose Reductase-like proteins disclosed below. The disclosed sequences have been named NOV16a, NOV16b, NOV16c, NOV16d, and NOV16e. Unless specifically addressed as NOV16a, NOV16b, NOV16c, NOV16d, or NOV16e, any reference to NOV16 is assumed to encompass all variants.

NOV16a

A disclosed NOV16a nucleic acid of 956 nucleotides (also referred to as CG55778-01)(SEQ ID NO:43) encoding a novel Aldose Reductase-like protein is shown in Table 16A. An open reading frame was identified beginning with an ATG initiation codon at nucleotides 31–33 and ending with a TGA codon at nucleotides 937–939. Putative untranslated regions upstream from the initiation codon and downstream from the termination codon are underlined. The start and stop codons are in bold in Table 16A.

TABLE 16A

| NOV16a nucleotide sequence |
|---|
| <u>GGCGGGGCGGCGGGGCGGCCGGCGGCGGCC</u>ATGGGAGATATCCCAGCCGTGGGCCTCAGC (SEQ ID NO:43) |
| TCCTGGAAGCAGGCTTCTCCAGGGAAAGTGACCGAGGCAGTGAAAGAGGCCATTGACGCA |
| GGGTACCGGCACTTCGACTGTGCTTACTTTTACCACAATGAGAGGGAGGTTGGAGCAGGG |
| ATCCGTTGCAAGATCAAGGAAGGCGCTGTAAGACGGGAGGATCTGTTCATTGCCACTAAG |
| CTGTGGTGCACCTGCCATAAGAAGTCCTTGGTGGAAACAGCATGCAGAAAGAGTCTCAAG |
| GCCTTGAAGCTGAACTATTTGGACCTCTACCTCATACACTGGCCCATGGGTTTCAAGCCT |
| CGAGTGCAGGACTTGCCTCTGGACGAGAGCAACATGGTTATTCCCAGTGACACGGACTTC |
| CTGGACACGTGGGAGGCCATGGAGGACCTGGTGATCACCGGGCTGGTGAAGAACATCGGG |
| GTGTCAAACTTCAACCATGAACAGCTTGAGAGGCTTTTGAATAAGCCTGGGTTGAGGTTC |
| AAGCCACTAACCAACCAGATTGAGTGCCACCCATATCTTACTCAGAAGAATCTGATCAGT |
| TTTTGCCAATCCAGAGATGTGTCCGTGACTGCTTACCGTCCTCTTGGTGGCTCTAGTGAG |
| GGGGTTGACCTGATAGACAACCCTGTGATCAAGAGGATTGCAAAGGAGCACGGCAAGTCT |
| CCTGCTCAGATTTTGATCCGATTTCAAATCCAGAGGAATGTGATAGTGATCCCCGGATCT |
| ATCACCCCAAGTCACATTAAAGAGAATATCCAGGTGTTTGATTTTGAATTAACACAGCAC |
| GATATGGATAACATCCTCAGCCTAAACAGGAATCTCCGACTGGCCATGTTCCCCAGAACT |
| AAAAATCACAAAGACTATCCTTTCCACATAGAATACTGA<u>GGACGCTTCCCCTTCCT</u> |

The aldose reductase NOV16a disclosed in this invention maps to chromosome 10.

In a search of sequence databases, it was found, for example, that the nucleic acid sequence of this invention has 740 of 922 bases (80%) identical to a gb:GENBANK-ID: MMU68535|acc:U68535.1 mRNA from *Mus musculus* (*Mus musculus* aldo-keto reductase mRNA, complete cds)

A disclosed NOV16a polypeptide (SEQ ID NO:44) encoded by SEQ ID NO:43 has 302 amino acid residues and is presented in Table 16B using the one-letter code. The SignalP, Psort and/or Hydropathy results predict that NOV16a has no signal peptide and is likely to be localized in the cytoplasm with a certainty of 0.6500. In an alternative embodiment, NOV16a is likely to be localized to the mitochondrial matrix space with a certainty of 0.1000 or to the lysosome (lumen) with a certainty of 0.1000.

implicated in various diseases and disorders described below and/or other pathologies. For example, the compositions of the present invention will have efficacy for treatment of patients suffering from: cancer, trauma, regeneration (in vitro and in vivo), viral/bacterial/parasitic infections, systemic lupus erythematosus, autoimmune disease, asthma, emphysema, scleroderma, allergy, ARDS, infertility and other diseases, disorders and conditions of the like.

TABLE 16B

NOV16a protein sequence

MGDIPAVGLSSWKQASPGKVTEAVKEAIDAGYRHFDCAYFYHNEREVGAGIRCKIKEGAV  (SEQ ID NO:44)

RREDLFIATKLWCTCHKKSLVETACRKSLKALKLNYLDLYLIHWPMGFKPRVQDLPLDES

NMVIPSDTDFLDTWEAMEDLVITGLVKNIGVSNFNHEQLERLLNKPGLRFKPLTNQIECH

PYLTQKNLISFCQSRDVSVTAYRPLGGSSEGVDLIDNPVIKRIAKEHGKSPAQILIRFQI

QRNVIVIPGSITPSHIKENIQVFDFELTQHDMDNILSLNRNLRLAMFPRTKNHKDYPFHI

EY

The full amino acid sequence of the protein of the invention was found to have 223 of 302 amino acid residues (73%) identical to, and 259 of 302 amino acid residues (85%) similar to, the 301 amino acid residue ptnr:SP-TREMBL-ACC:O09125 protein from *Mus musculus* (Mouse) (ALDO-KETO REDUCTASE).

The aldose reductase disclosed in this invention is expressed in at least the following tissues: lung, testis, germ cell. The nucleic acids and proteins of the invention are useful in potential diagnostic and therapeutic applications NOV16b A disclosed NOV16b nucleic acid of 875 nucleotides (also referred to as CG55778-02)(SEQ ID NO:45) encoding a novel Aldose Reductase-like protein is shown in Table 16C. An open reading frame was identified beginning with an ATG initiation codon at nucleotides 23–25 and ending with a TGA codon at nucleotides 776–778. Putative untranslated regions upstream from the initiation codon and downstream from the termination codon are underlined. The start and stop codons are in bold in Table 16C.

TABLE 16C

NOV16b nucleotide sequence

<u>GGCGGGGCGGCCGGCGGCGGCC</u>ATGGGAGATATCCCAGCCGTGGGCCTCAGCTCCTGGAA  (SEQ ID NO:45)

GCAGGCTTCTCCAGGAAAAGTGACCGAGGCAGTGAAAGAGGCCATTGACGCAGGGTACCG

GCACTTCGACTGTGCTTACTTTTACCACAATGAGAGGGAGGTTGGAGCAGGGATCCGTTG

CAAGATCAAGGAAGGCGCTGTAAGACGGGAGGATCTGTTCATTGCCACTAAGCTGTGGTG

CACCTGCCATAAGAAGTCCTTGGTGGAAACAGCATGCAGAAAGGGTCTCAAGGCCTTGAA

GCTGAACTATTTGGACCTCTACCTCATACACTGGCCCATGGGTTTCAAGCCTCCTCATCC

AGAATGGATCATGAGCTGCAGTGAACTTTCCTTCTGCCTCTCACATCCTCGAGTGCAGGA

CTTGCCTCTGGACGAGAGCAACATGGTTATTCCCAGTGACACGGACTTCCTGGACACGTG

GGAGGCCATGGAGGACCTGGTGATCACCGGGCTGGTGAAGAACATCGGGGTGTCAAACTT

CAACCATGAACAGCTTGAGAGGCTTTTGAATAAGCCTGGGTTGAGGTTCAAGCCACTAAC

CAACCAGATTTTGATCCGATTTCAAATCCAGAGGAATGTGATAGTGATCCCCGGATCTAT

CACCCCAAGTCACATTAAAGAGAATATCCAGGTGTTTGATTTTGAATTAACACAGCACGA

TATGGATAACATCCTCAGCCTAAACAGGAATCTCCGACTGGCCATGTTCCCCATGTAA<u>AT</u>

<u>ATGGCTCCTTCTTTTTAAAACAGAGGGAAGAATATACAGATTGAATGATTGGTGTCTGAA</u>

<u>TAGAACTAAAAATCACAAAGACTATCCTTTCCACA</u>

NOV16b is a splice form of CG55778_01 with an alternatively spliced exon 4, deletion of exon 6 and 7, and a different C-terminus with exon 10 missing. The aldose reductase NOV16b disclosed in this invention maps to chromosome 10.

In a search of sequence databases, it was found, for example, that the nucleic acid sequence of this invention has 634 of 657 bases (96%) identical to a gb:GENBANK-ID: AF263242|acc:AF263242.1 mRNA from *Homo sapiens* (*Homo sapiens* aldo-keto reductase loopADR mRNA, complete cds).

A disclosed NOV16b polypeptide (SEQ ID NO:46) encoded by SEQ ID NO:45 has 251 amino acid residues and is presented in Table 16D using the one-letter code. The SignalP, Psort and/or Hydropathy results predict that NOV16b has no signal peptide and is likely to be localized in the cytoplasm with a certainty of 0.4500. In an alternative embodiment, NOV16b is likely to be localized to the microbody (peroxisome) with a certainty of 0.1047, or to the mitochondrial matrix space with a certainty of 0.1000, or to the lysosome (lumen) with a certainty of 0.1000.

BLNEW-ACC:AAK58523 protein from *Homo sapiens* (Human) (ALDO-KETO REDUCTASE LOOPADR).

The ALDOSE REDUCTASE-like gene disclosed in this invention is expressed in at least the following tissues: lung, testis, germ cell. The nucleic acids and proteins of the invention have applications in the diagnosis and/or treatment of various diseases and disorders. For example, the compositions of the present invention will have efficacy for the treatment of patients suffering from: cancer, trauma, regeneration (in vitro and in vivo), viral/bacterial/parasitic infections, systemic lupus erythematosus, autoimmune disease, asthma, emphysema, scleroderma, allergy, ARDS, infertility, as well as other diseases, disorders and conditions.

NOV16c

A disclosed NOV16c nucleic acid of 752 nucleotides (also referred to as CG55778-03)(SEQ ID NO:47) encoding a novel Aldose Reductase-like protein is shown in Table 16E. An open reading frame was identified beginning with an

TABLE 16D

NOV16b protein sequence

MGDIPAVGLSSWKQASPGKVTEAVKEAIDAGYRHFDCAYFYHNEREVGAGIRCKIKEGAV  (SEQ ID NO:46)

RREDLFIATKLWCTCHKKSLVETACRKGLKALKLNYLDLYLIHWPMGFKPPHPEWIMSCS

ELSFCLSHPRVQDLPLDESNMVIPSDTDFLDTWEAMEDLVITGLVKNIGVSNFNHEQLER

LLNKPGLRFKPLTNQILIRFQIQRNVIVIPGSITPSHIKENIQVFDFELTQNDMDNILSL

NRNLRLAMFPM

The full amino acid sequence of the protein of the invention was found to have 197 of 207 amino acid residues (95%) identical to, and 200 of 207 amino acid residues (96%) similar to, the 320 amino acid residue ptnr:TREM- ATG initiation codon at nucleotides 23–25 and ending with a TAA codon at nucleotides 653–655. Putative untranslated regions upstream from the initiation codon and downstream from the termination codon are underlined. The start and stop codons are in bold in Table 16E.

TABLE 16E

NOV16c nucleotide sequence

GGCGGGGCGGCCGGCGGCGGCCATGGGAGATATCCCAGCCGTGGGCCTCAGCTCCTGGAA  (SEQ ID NO:47)

GCAGGCTTCTCCAGGTAAAGTGACCGAGGCAGTGAAAGAGGCCATTGACGCAGGGTACCG

GCACTTCGACTGTGCTTACTTTTACCACAATGAGAGGGAGGTTGGAGCAGGGATCCGTTG

CAAGATCAAGGAAGGCGCTGTAAGACGGGAGGATCTGTTCATTGCCACTAAGCTGTGGTG

CACCTGCCATAAGAAGTCCTTGGTGGAAACAGCATGCAGAAAGAGTCTCAAGGCCTTGAA

GCTGAACTATTTGGACCTCTACCTCATACACTGGCCCATGGGTTTCAAGCCTCCTCATCC

AGAATGGATCATGAGCTGCAGTGAACTTTCCTTCTGCCTCTCACATCCTCGAGTGCAGGA

CTTGCCTCTGGACGAGAGCAACATGGTTATTCCCAGTGACACGGACTTCCTGGACACGTG

GGAGATTTTGATCCGATTTCAAATCCAGAGGAATGTGATAGTGATCCCCGGATCTATCAC

CCCAAGTCACATTAAAGAGAATATCCAGGTGTTTGATTTTGAATTAACACAGCACGATAT

GGATAACATCCTCAGCCTAAACAAGAATCTCCGACTGGCCATGTTCCCCATGTAAATATG

GCTCCTTCTTTTTAAAACAGAGGGAAGAATATACAGATTGAATGATTGGTGTCTGAATAG

AACTAAAAATCACAAAGACTATCCTTTCCACA

NOV16c is a splice form of Aldo-Keto Reductase with an alternatively spliced exon 4, deletion of exons 5, 6, and 7, and a different C-terminus with exon 10 missing. The aldose reductase NOV16c disclosed in this invention maps to chromosome 10.

In a search of sequence databases, it was found, for example, that the nucleic acid sequence of this invention has 478 of 482 bases (99%) identical to a gb:GENBANK-ID: AF263242|acc:AF263242.1 mRNA from Homo sapiens (Homo sapiens aldo-keto reductase loopADR mRNA, complete cds).

A disclosed NOV16c polypeptide (SEQ ID NO:48) encoded by SEQ ID NO:47 has 210 amino acid residues and is presented in Table 16F using the one-letter code. The SignalP, Psort and/or Hydropathy results predict that NOV16c has no signal peptide and is likely to be localized in the cytoplasm with a certainty of 0.4500. In an alternative embodiment, NOV16c is likely to be localized to the microbody (peroxisome) with a certainty of 0.2365, or to the mitochondrial matrix space with a certainty of 0.1000, or to the lysosome (lumen) with a certainty of 0.1000.

testis, germ cell. The sequence is predicted to be expressed in the following tissues because of the expression pattern of (GENBANK-ID: gb:GENBANK-ID:AF263242|acc:AF263242.1) a closely related Homo sapiens aldo-keto reductase loopADR mRNA, complete cds homolog in species Homo sapiens: small intestine.

The nucleic acids and proteins of the invention have applications in the diagnosis and/or treatment of various diseases and disorders. For example, the compositions of the present invention will have efficacy for the treatment of patients suffering from: cancer, trauma, regeneration (in vitro and in vivo), viral/bacterial/parasitic infections, systemic lupus erythematosus, autoimmune disease, asthma, emphysema, scleroderma, allergy, ARDS, infertility, as well as other diseases, disorders and conditions.

NOV16d

A disclosed NOV16d nucleic acid of 785 nucleotides (also referred to as CG55778-04)(SEQ ID NO:49) encoding

TABLE 16F

NOV16c protein sequence

MGDIPAVGLSSWKQASPGKVTEAVKEAIDAGYRHFDCAYFYHNEREVGAGIRCKIKEGAV  (SEQ ID NO:48)

RREDLFIATKLWCTCHKKSLVETACRKSLKALKLNYLDLYLIHWPMGFKPPHPEWIMSCS

ELSFCLSHPRVQDLPLDESNMVIPSDTDFLDTWEILIRFQIQRNVIVIPGSITPSHIKEN

IQVFDFELTQHDMDNILSLNKNLRLAMFPM

The full amino acid sequence of the protein of the invention was found to have 153 of 156 amino acid residues (98%) identical to, and 154 of 156 amino acid residues (98%) similar to, the 307 amino acid residue ptnr:SP-TREMBL-ACC:Q9BU71 protein from Homo sapiens (Human) (SIMILAR TO ALDO-KETO REDUCTASE).

The Aldo-Keto Reductase-like gene disclosed in this invention is expressed in at least the following tissues: lung, a novel Aldose Reductase-like protein is shown in Table 16G. An open reading frame was identified beginning with an ATG initiation codon at nucleotides 31–33 and ending with a TGA codon at nucleotides 766–768. Putative untranslated regions upstream from the initiation codon and downstream from the termination codon are underlined. The start and stop codons are in bold in Table 16G.

TABLE 16G

NOV16d nucleotide sequence

<u>GGCGGGGCGGCGGGGCGGCCGGCGGCGGCC</u>ATGGGAGATATCCCAGCCGTGGGCCTCAGC  (SEQ ID NO:49)

TCCTGGAAGCAGGCTTCTCCAGGGAAAGTGACCGAGGCAGTGAAAGAGGCCATTGACGCA

GGGTACCGGCACTTCGACTGTGCTTACTTTTACCACAATGAGAGGGAGGTTGGAGCAGGG

ATCCGTTGCAAGATCAAGGAAGGCGCTGTAAGACGGGAGGATCTGTTCATTGCCACTAAG

CTGTGGTGCACCTGCCATAAGAAGTCCTTGGTGGAAACAGCATGCAGAAAGAGTCTCAAG

GCCTTGAAGCTGAACTATTTGGACCTCTACCTCATACACTGGCCCATGGGTTTCAAGCCT

CGAGTGCAGGACTTGCCTCTGGACGAGAGCAACATGGTTATTCCCAGTGACACGGACTTC

CTGGACACGTGGGAGGCCATGGAGGACCTGGTGATCACCGGGCTGGTGAAGAACATCGGG

GTGTCAAACTTCAACCATGAACAGCTTGAGAGGCTTTTGAATAAGCCTGGGTTGAGGTTC

AAGCCACTAACCAACCAGATTTTGATCCGATTTCAAATCCAGAGGAATGTGATAGTGATC

CCCGGATCTATCACCCCAAGTCACATTAAAGAGAATATCCAGGTGTTTGATTTTGAATTA

ACACAGCACGATATGGATAACATCCTCAGCCTAAACAGGAATCTCCGACTGGCCATGTTC

TABLE 16G-continued

NOV16d nucleotide sequence

CCCAGAACTAAAAATCACAAAGACTATCCTTTCCACATAGAATACTGAGGACGCTTCCCC

TTCCT

The aldose reductase NOV16d disclosed in this invention maps to chromosome 10.

In a search of sequence databases, it was found, for example, that the nucleic acid sequence of this invention has 358 of 361 bases (99%) identical to a gb:GENBANK-ID: BC002862|acc:BC002862.1 mRNA from *Homo sapiens* (*Homo sapiens*, Similar to aldo-keto reductase, clone MGC: 10612 IMAGE:3941289, mRNA, complete cds)

A disclosed NOV16d polypeptide (SEQ ID NO:50) encoded by SEQ ID NO:49 has 245 amino acid residues and is presented in Table 16H using the one-letter code. The SignalP, Psort and/or Hydropathy results predict that NOV16d has no signal peptide and is likely to be localized in the cytoplasm with a certainty of 0.4500. In an alternative embodiment, NOV16d is likely to be localized to the lysosome (lumen) with a certainty of 0.1602, or to the microbody (peroxisome) with a certainty of 0.1369, or to the mitochondrial matrix space with a certainty of 0.1000.

The ALDO-KETO REDUCTASE-like gene disclosed in this invention is expressed in at least the following tissues: Adipose, Testis. The nucleic acids and proteins of the invention have applications in the diagnosis and/or treatment of various diseases and disorders. For example, the compositions of the present invention will have efficacy for the treatment of patients suffering from: cancer, trauma, regeneration (in vitro and in vivo), viral/bacterial/parasitic infections, systemic lupus erythematosus, autoimmune disease, asthma, emphysema, scleroderma, allergy, ARDS, infertility and other diseases as well as other diseases, disorders and conditions.

NOV16e

A disclosed NOV16e nucleic acid of 937 nucleotides (also referred to as CG55778-05)(SEQ ID NO:51) encoding a novel Aldose Reductase-like protein is shown in Table 16I. An open reading frame was identified beginning with an

TABLE 16H

NOV16d protein sequence

MGDIPAVGLSSWKQASPGKVTEAVKEAIDAGYRHFDCAYFYHNEREVGAGIRCKIKEGAV  (SEQ ID NO:50)

RREDLFIATKLWCTCHKKSLVETACRKSLKALKLNYLDLYLIHWPMGFKPRVQDLPLDES

NMVIPSDTDFLDTWEAMEDLVITGLVKNIGVSNFNHEQLERLLNKPGLRFKPLTNQILIR

FQIQRNVIVIPGSITPSHIKENIQVFDFELTQHDMDNILSLNRNLRLAMFPRTKNHKDYP

FHIEY

The full amino acid sequence of the protein of the invention was found to have 109 of 110 amino acid residues (99%) identical to, and 109 of 110 amino acid residues (99%) similar to, the 307 amino acid residue ptnr:SP-TREMBL-ACC:Q9BU71 protein from *Homo sapiens* (Human) (SIMILAR TO ALDO-KETO REDUCTASE).

ATG initiation codon at nucleotides 31–33 and ending with a TAA codon at nucleotides 838–840. Putative untranslated regions upstream from the initiation codon and downstream from the termination codon are underlined. The start and stop codons are in bold in Table 16I.

TABLE 16I

NOV16e nucleotide sequence

GGCGGGGCGGCGGGGCGGCCGGCGGCGGCCATGGGAGATATCCCAGCCGTGGGCCTCAGC  (SEQ ID NO:51)

TCCTGGAAGCAGGCTTCTCCAGGGAAAGTGACCGAGGCAGTGAAAGAGGCCATTGACGCA

GGGTACCGGCACTTCGACTGTGCTTACTTTTACCACAATGAGAGGGAGGTTGGAGCAGGG

ATCCGTTGCAAGATCAAGGAAGGCGCTGTAAGACGGGAGGATCTGTTCATTGCCACTAAG

CCTCCTCATCCAGAATGGATCATGAGCTGCAGTGAACTTTCCTTCTGCCTCTCACATCCT

CGAGTGCAGGACTTGCCTCTGGACGAGAGCAACATGGTTATTCCCAGTGACACGGACTTC

CTGGACACGTGGGAGGCCATGGAGGACCTGGTGATCACCGGGCTGGTGAAGAACATCGGG

GTGTCAAACTTCAACCATGAACAGCTTGAGAGGCTTTTGAATAAGCCTGGGTTGAGGTTC

AAGCCACTAACCAACCAGATTGAGTGCCACCCATATCTTACTCAGAAGAATCTGATCAGT

TABLE 161-continued

NOV16e nucleotide sequence

TTTTGCCAATCCAGAGATGTGTCCGTGACTGCTTACCGTCCTCTTGGTGGCTCGTGTGAG

GGGGTTGACCTGATAGACAACCCTGTGATCAAGAGGATTGCAAAGGAGCACGGCAAGTCT

CCTGCTCAGATTTTGATCCGATTTCAAATCCAGAGGAATGTGATAGTGATCCCCGGATCT

ATCACCCCAAGTCACATTAAAGAGAATATCCAGGTGTTTGATTTTGAATTAACACAGCAC

GATATGGATAACATCCTCAGCCTAAACAGGAATCTCCGACTGGCCATGTTCCCCATGTAA

ATATGGCTCCTTCTTTTTAAAACAGAGGGAAGAATATACAGATTGAATGATTGGTGTCTG

AATAGAACTAAAAATCACAAAGACTATCCTTTCCACA

The aldose reductase NOV16e disclosed in this invention maps to chromosome 10.

In a search of sequence databases, it was found, for example, that the nucleic acid sequence of this invention has 700 of 700 bases (100%) identical to a gb:GENBANK-ID: BC002862|acc:BC002862.1 mRNA from *Homo sapiens* (*Homo sapiens*, Similar to aldo-keto reductase, clone MGC: 10612 IMAGE:3941289, mRNA, complete cds).

A disclosed NOV16e polypeptide (SEQ ID NO:52) encoded by SEQ ID NO:51 has 269 amino acid residues and is presented in Table 16J using the one-letter code. The SignalP, Psort and/or Hydropathy results predict that NOV16e has no signal peptide and is likely to be localized in the cytoplasm with a certainty of 0.4500. In an alternative embodiment, NOV16e is likely to be localized to the lysosome (lumen) with a certainty of 0.1602, or to the microbody (peroxisome) with a certainty of 0.1369, or to the mitochondrial matrix space with a certainty of 0.1000.

The full amino acid sequence of the protein of the invention was found to have 206 of 233 amino acid residues (88%) identical to, and 211 of 233 amino acid residues (90%) similar to, the 307 amino acid residue ptnr:SP-TREMBL-ACC:Q9BU71 protein from *Homo sapiens* (Human) (SIMILAR TO ALDO-KETO REDUCTASE).

The ALDO-KETO REDUCTASE-like gene disclosed in this invention is expressed in at least the following tissues: Adipose, Testis. The nucleic acids and proteins of the invention have applications in the diagnosis and/or treatment of various diseases and disorders. For example, the compositions of the present invention will have efficacy for the treatment of patients suffering from: cancer, trauma, regeneration (in vitro and in vivo), viral/bacterial/parasitic infections, systemic lupus erythematosus, autoimmune disease, asthma, emphysema, scleroderma, allergy, ARDS, infertility and other diseases as well as other diseases, disorders and conditions.

NOV16a, NOV16b, NOV16c, NOV15d and NOV15e are very closely homologous as is shown in the amino acid alignment in Table 16K.

TABLE 16J

NOV16e protein sequence

MGDIPAVGLSSWKQASPGKVTEAVKEAIDAGYRHFDCAYFYHNEREVGAGIRCKIKEGAV  (SEQ ID NO:52)

RREDLFIATKPPHPEWIMSCSELSFCLSHPRVQDLPLDESNMVIPSDTDFLDTWEAMEDL

VITGLVKNIGVSNFNHEQLERLLNKPGLRFKPLTNQIECHPYLTQKNLISFCQSRDVSVT

AYRPLGGSCEGVDLIDNPVIKRIAKEHGKSPAQILIRFQIQRNVIVIPGSITPSHIKENI

QVFDFELTQHDMDMILSLNRNLRLAMFPM

Table 16K. Clustal W Alignment of NOV16a and NOV16b and NOV16c and NOV16d and NOV16e

```
                10        20        30        40        50        60        70        80
             ....|....|....|....|....|....|....|....|....|....|....|....|....|....|....|....|
CG55778_01   MGDIPAVGLSSWKQASPGKVTEAVKEAIDAGYRHFDCAYFYHNEREVGAGIRCKIKEGAVRREDLFIATKLWCTCHKKSL
```

```
CG55778_02  MGDIPAVGLSSWKQASPGKVTEAVKEAIDAGYRHFDCAYFYHNEREVGAGIRCKIKEGAVRREDLFIATKLWCTCHKKSL
CG55778_03  MGDIPAVGLSSWKQASPGKVTEAVKEAIDAGYRHFDCAYFYHNEREVGAGIRCKIKEGAVRREDLFIATKLWCTCHKKSL
CG55778_04  MGDIPAVGLSSWKQASPGKVTEAVKEAIDAGYRHFDCAYFYHNEREVGAGIRCKIKEGAVRREDLFIATKLWCTCHKKSL
CG55778_05  MGDIPAVGLSSWKQASPGKVTEAVKEAIDAGYRHFDCAYFYHNEREVGAGIRCKIKEGAVRREDLFIATP---PPHPEWI 90       100       110       120       130       140       150       160
                ....|....|....|....|....|....|....|....|....|....|....|....|....|....|....|....|
CG55778_01  VETACRKSLKALKLNYLDLYLIHWPMGFKP------------------RVQDLPLDESNMVIPSDTDFLDTWEAMEDLV
CG55778_02  VETACRKGLKALKLNYLDLYLIHWPMGFKPPHPEWIMSCSELSFCLSHPRVQDLPLDESNMVIPSDTDFLDTWEAMEDLV
CG55778_03  VETACRKSLKALKLNYLDLYLIHWPMGFKPPHPEWIMSCSELSFCLSHPRVQDLPLDESNMVIPSDTDFLDTWE------
CG55778_04  VETACRKSLKALKLNYLDLYLIHWPMGFKP------------------RVQDLPLDESNMVIPSDTDFLDTWEAMEDLV
CG55778_05  MS--CS-E--------LSFCLSH------P------------------RVQDLPLDESNMVIPSDTDFLDTWEAMEDLV 170       180       190       200       210       220       230       240
                ....|....|....|....|....|....|....|....|....|....|....|....|....|....|....|....|
CG55778_01  ITGLVKNIGVSNFNHEQLERLLNKPGLRFKPLTNQIECHPYLTQKNLISFCQSRDVSVTAYRPLGGSSEGVDLIDNPVIK
CG55778_02  ITGLVKNIGVSNFNHEQLERLLNKPGLRFKPLT-----------------------------------------------
CG55778_03  --------------------------------------------------------------------------------
CG55778_04  ITGLVKNIGVSNFNHEQLERLLNKPGLRFKPLT-----------------------------------------------
CG55778_05  ITGLVKNIGVSNFNHEQLERLLNKPGLRFKPLTNQIECHPYLTQKNLISFCQSRDVSVTAYRPLGGSCEGVDLIDNPVIK 250       260       270       280       290       300       310       320
                ....|....|....|....|....|....|....|....|....|....|....|....|....|....|....|....|
CG55778_01  RIAKEHGKSPAQILIRFQIQRNVIVIPGSITPSHIKENIQVFDFELTQHDMDNILSLNRNLRLAMFPRTKNHKDYPFHIE
CG55778_02  -----------NQILIRFQIQRNVIVIPGSITPSHIKENIQVFDFELTQHDMDNILSLNRNLRLAMFPM-----------
CG55778_03  -----------QILIRFQIQRNVIVIPGSITPSHIKENIQVFDFELTQHDMDNILSLNRNLRLAMFPM-----------
CG55778_04  -----------NQILIRFQIQRNVIVIPGSITPSHIKENIQVFDFELTQHDMDNILSLNRNLRLAMFPRTKNHKDYPFHIE
CG55778_05  RIAKEHGKSPAQILIRFQIQRNVIVIPGSITPSHIKENIQVFDFELTQHDMDNILSLNRNLRLAMFPM-----------

CG55778_01  Y    (SEQ ID NO:44)
CG55778_02  -    (SEQ ID NO:46)
CG55778_03  -    (SEQ ID NO:48)
CG55778_04  Y    (SEQ ID NO:50)
CG55778_05  -    (SEQ ID NO:52)
```

In a search of public sequence databases, NOV16a was found to have homology to the amino acid sequences shown in the BLASTP data listed in Table 16L.

TABLE 16L

BLASTP results for NOV16a

| Gene Index/ Identifier | Protein/Organism | Length (aa) | Identity (%) | Positives (%) | Expect |
|---|---|---|---|---|---|
| ptnr:SPTREMBL-ACC:Q96JD6 | ALDO-KETO REDUCTASE LOOPADR - *Homo sapiens* | 320 | 190/193 (98%) | 190/193 (98%) | 1.8e-159 |
| ptnr:SPTREMBL-ACC:Q9BU71 | SIMILAR TO ALDO-KETO REDUCTASE - *Homo sapiens* | 307 | 178/179 (99%) | 178/179 (99%) | 5.8e-152 |
| ptnr:SPTREMBL-ACC:Q9DCT1 | 18100E1I10RIK PROTEIN (RIKEN CDNA 1810061I10 GENE) - *Mus musculus* | 301 | 225/302 (74%) | 260/302 (86%) | 5.0e-124 |
| ptnr:SPTREMBL-ACC:O09125 | ALDO-KETO REDUCTASE - *Mus musculus* | 301 | 223/302 (73%) | 259/302 (85%) | 3.5e-123 |
| ptnr:SPTREMBL-ACC:Q9D8L2 | 1810061I10RIK PROTEIN - *Mus musculus* | 276 | 205/274 (74%) | 235/274 (85%) | 9.8e-112 |

Other BLAST results include sequences from the Patp database, which is a propriety database that contains sequences published in patents and patent publications. Patp results include those listed in Table 16M.

TABLE 16M

Patp BLASTP Analysis for NOV16a

| Sequences producing High-scoring Segment Pairs | Protein/Organism | Length (aa) | Identity (%) | Positive (%) | E Value |
|---|---|---|---|---|---|
| patp:AAM80263 | Human protein SEQ ID NO 3909 - *Homo sapiens* | 264 | 126/127 (99%) | 126/127 (99%) | 6.4e-123 |
| patp:AAR15425 | Human aldose reductase - *Homo sapiens* | 316 | 180/304 (59%) | 226/304 (74%) | 1.4e-96 |
| patp:AAR06652 | Placenta-specific protein-9 - *Homo sapiens* | 316 | 179/304 (58%) | 226/304 (74%) | 2.9e-96 |
| patp:AAW69357 | Rat lens aldose reductase - *Rattus* sp | 316 | 178/303 (58%) | 221/303 (72%) | 3.8e-94 |
| patp:AAB10871 | Murine MVDP protein - *Mus* sp | 316 | 180/304 (59%) | 222/304 (73%) | 6.3e-92 |

Table 16N lists the domain description from DOMAIN analysis results against NOV16a.

Table 16N. Domain Analysis of NOV16a

```
Pfam analysis

Model           Domain  seq-f  seq-t    hmm-f hmm-t    score   E-value
    -------         ------  -----  -----    ----- -----    -----   -------
    ROK             1/1        27     43 ..     1    17 [.   7.3      0.42
    DNA_methylase   1/1       218    229 ..   407   418 .]   3.0      5.9
    aldo_ket_red    1/1         4    282 ..     9   368 .] 430.9  1.4e-127

Alignments of top-scoring domains:
    ROK: domain 1 of 1, from 27 to 43: score 7.3, E = 0.42
 (SEQ ID NO:212)                 giDlGgTkielalvded<-*
                                             +||+|++++ +|+++ +
    NOV16a      (SEQ ID NO:396)   27   AIDAGYRHFDCAYFYHN    43

DNA_methylase: domain 1 of 1, from 218 to 229: score 3.0, E = 5.9
 (SEQ ID NO:213)                 pvaeaIakeikk<-*
                                             ||+++|||++|
    NOV16a      (SEQ ID NO:397)  218   PVIKRIAKEHGK    229 aldo_ket_red: domain 1 of 1, from 4 to 282: score 430.9, E = 1.4e-127
 (SEQ ID NO:214)                 mPllGlGtwqtpgeedylwgrvdkeeakeavkaAldaGYRhiDtAai
                                         +|++||  |+           +++++ +
||||+|+||||||+|+|++
    NOV16a      (SEQ ID NO:398)   4   IPAVGLSSWK----------
QASPGKVTEAVKEAIDAGYRHFDCAYF 40

YgNGqkPgqSEeevGeaikealeegsvvvitkykRediFitsdKlwntfg
                 |+|       |+|||++|+ ++ ||  |    |||+|| + |||+|
              41 YHN-------EREVGAGIRCKIKEG-AV-----RREDLFIAT-KLWCTC-   75 pDlseyghspkhvrealekSLkrLgLdYvDLyLiHwPdpfkpgiedkypl
                 | + +|+ |++||||  |+| |+||||||||++|||     +++
```

```
 76 -------HKKSLVETACRKSLKALKLNYLDLYLIHWPMGFKPR--VQDL- 115 gfptdddgkliyedvpieetWkAleklvdeGkvrsIGVSNfsaeqleell
    |  |+ + +|+ |+++++||+|+|+|| +|+|+ ||||||++||||+||
116 --PLDESNMVIPSDTDFLDTWEAMEDLVITGLVKNIGVSNFNHEQLERLL 163 syagklklipPvvnQvElHPylrqdelrkvPLLpfCkshGIavtAySPLg
    +++|  |+ ++|  +||+|+|||+|+  |+       ||+| ++ |||| |||
164 NKPG-LR-FKPLTNQIECHPYLTQKNLIS-----FCQSRDVSVTAYRPLG 206 sGlLtGkykteedipgdrrsllgadkgwselgspelledpvlkaiAekyg
    +  +              +|       ++||+|+||+++|
207 GSS--------------EG----------VDLIDNPVIKRIAKEHG 228 ykdktpAQvaLrWalqrGgGagvvvvIPKSsnpeRikeNlkafddfeLte
    |+|||+++|+++||+     |+|||+| +|++||||+++|  |||||+
229 ---KSPAQILIRFQIQRN-----VIVIPGSITPSHIKENIQVF-DFELTQ 269 edmkaideldrgk<-*
    ||+ | +|+|+
270 HDMDNILSLNRNL    282
```

In a search of public sequence databases, NOV16b was found to have homology to the amino acid sequences shown in the BLASTP data listed in Table 16O.

TABLE 16O

BLASTP results for NOV16b

| Gene Index/ Identifier | Protein/Organism | Length (aa) | Identity (%) | Positives (%) | Expect |
|---|---|---|---|---|---|
| ptnr:SPTREMBL-ACC:Q9BU71 | SIMILAR TO ALDO-KETO REDUCTASE - *Homo sapiens* | 307 | 197/207 (95%) | 200/207 (96%) | 1.4e-105 |
| ptnr:SPTREMBL-ACC:Q9GJD6 | ALDO-KETO REDUCTASE LOOPADR - *Homo sapiens* | 320 | 197/207 (95%) | 200/207 (96%) | 1.4e-105 |
| ptnr:SPTREMBL-ACC:Q9DCT1 | 1810061I10RIK PROTEIN (RIKEN CDNA 1810061I10 GENE) - *Mus musculus* | 301 | 82/110 (74%) | 93/110 (84%) | 4.3e-91 |
| ptnr:SPTREMBL-ACC:O09125 | ALDO-KETO REDUCTASE - *Mus musculus* | 301 | 81/110 (73%) | 93/110 (84%) | 3.0e90 |
| ptnr:SPTREMBL-ACC:Q9D8L2 | 1810061I10RIK PROTEIN - *Mus musculus* | 276 | 82/110 (74%) | 93/110 (84%) | 2.9e-86 |

Other BLAST results include sequences from the Patp database, which is a propriety database that contains sequences published in patents and patent publications. Patp results include those listed in Table 16P.

TABLE 16P

Patp BLASTP Analysis for NOV16b

| Sequences producing High-scoring Segment Pairs | Protein/Organism | Length (aa) | Identity (%) | Positive (%) | E Value |
|---|---|---|---|---|---|
| patp:AAM79279 | Human protein SEQ ID NO 1941 - *Homo sapiens* | 263 | 246/251 (98%) | 247/251 (98%) | 3.0e-133 |
| patp:AAM80263 | Human protein SEQ ID NO 3909 - *Homo sapiens* | 264 | 195/207 (94%) | 198/207 (95%) | 1.2e-104 |
| patp:AAR15425 | Human aldose reductase - *Homo sapiens* | 316 | 68/107 (63%) | 84/107 (78%) | 1.1e-73 |
| patp:AAR06652 | Placenta-specific protein-9 - *Homo sapiens* | 316 | 67/107 (62%) | 84/107 (78%) | 2.3e-73 |
| patp:AAW69357 | Rat lens aldose reductase - *Rattus* sp | 316 | 66/107 (61%) | 84/107 (78%) | 2.9e-73 |

Table 16Q lists the domain description from DOMAIN analysis results against NOV16b.

Table 16Q. Domain Analysis of NOV16b

Pfam analysis

```
    Model       Domain  seq-f  seq-t    hmm-f  hmm-t     score   E-value
    --------    ------  -----  -----    -----  -----     -----   -------
    ROK          1/1      27     43  ..    1     17 [.    7.3     0.42
    aldo_ket_red 1/3       4    110  ..    9    147 ..  154.1    4.1e-45
    aldo_ket_red 2/3     135    196  ..  158    221 ..   72.2    9.9e-21
    aldo_ket_red 3/3     197    244  ..  315    368 .]   67.7    2.2e-19

Alignments of top-scoring domains:
    ROK: domain 1 of 1, from 27 to 43: score 7.3, E = 0.42
 (SEQ ID NO:215)                giDlGgTkielalvded<-*
                                +||+|++++ +|+++ +
    NOV16b    (SEQ ID NO:399)  27    AIDAGYRHFDCAYFYHN   43 aldo_ket_red: domain 1 of 3, from 4 to 110: score 154.1, E = 4.1e-45
 (SEQ ID NO:216)           mPllGlGtwqtpgeedylwgrvdkeeakeavkaAldaGYRhiDtAai
                           +|++||   |+                    +++++ +
||||+|+|||||+|+|++
    NOV16b    (SEQ ID NO:400)  4    IPAVGLSSWK----------
QASPGKVTEAVKEAIDAGYRHFDCAYF 40

YgNGqkPgqSEeevGeaikealeegsvvvitkykRediFitsdKlwntfg
                           |+|       |+|||++|+ ++ ||  |      |||+|| + |||+|
                        41 YHN------EREVGAGIRCKIKEG-AV-----RREDLFIAT-KLWCTC-  75 pDlseyghspkhvrealekSLkrLgLdYvDLyLiHwPdpfkp<-*
                            | + +|+ |++| || |+| |+|.||||||++|||
                        76 -------HKKSLVETACRKGLKALKLNYLDLYLIHWPMGFKP        110 aldo_ket_red: domain 2 of 3, from 135 to 196: score 72.2, E = 9.9e-21
 (SEQ ID NO:217)           ptdddgkliyedvpieetWkAleklvdeGkvrsIGVSNfsaeqleel
                             |+ + +|+ |+++++||+|+|+||
+|+|+ ||||||++||||+|
    NOV16b    (SEQ ID NO:401) 135
PLDESNMVIPSDTDFLDTWEAMEDLVITGLVKNIGVSNFNHEQLERL 181 lsyagklklipPvvnQv<-*
                           |+++| |+ ++| +||+
                       182 LNKPG-LR-FKPLTNQI    196 aldo_ket_red: domain 3 of 3, from 197 to 244: score 67.7, E = 2.2e-19
 (SEQ ID NO:218)           aLrWalqrGgGagvvvvIPKSsnpeRikeNlkafddfeLteedmkai
                           ++|+++||+      |+|||+|
```

```
+|++|||+++|  ||||+ ||+ |
   NOV16b    (SEQ ID NO:402) 197    LIRFQIQRN-----VIVIPGSITPSHIKENIQVF-
DFELTQHDMDNI 237 deldrgk<-*
                               +|+|+
                         238   LSLNRNL    244
```

The aldo-keto reductase family includes a number of related monomeric NADPH-dependent oxidoreductases, such as aldehyde reductase, aldose reductase, prostaglandin F synthase, xylose reductase, rho crystallin, and many others. All possess a similar structure, with a beta-alpha-beta fold characteristic of nucleotide binding proteins. The fold comprises a parallel beta-8/alpha-8-barrel, which contains a novel NADP-binding motif. The binding site is located in a large, deep, elliptical pocket in the C-terminal end of the beta sheet, the substrate being bound in an extended conformation. The hydrophobic nature of the pocket favours aromatic and apolar substrates over highly polar ones.

Binding of the NADPH coenzyme causes a massive conformational change, reorienting a loop, effectively locking the coenzyme in place. This binding is more similar to FAD- than to NAD(P)-binding oxidoreductases. This indicates that the sequence of the invention has properties similar to those of other proteins known to contain this/these domain(s) and similar to the properties of these domains.

The aldo-keto reductase family includes a number of related monomeric NADPH-dependent oxidoreductases, such as aldose reductase, prostaglandin F synthase, xylose reductase, aldehyde reductases, hydroxysteroid dehydrogenases, dihydrodiol dehydrogenases and many others. All possess a similar structure, with a beta-alpha-beta fold characteristic of nucleotide binding proteins. The fold comprises a parallel beta-8/alpha-8-barrel, which contains a novel NADP-binding motif. The (alpha/beta)8-barrel fold provides a common scaffold for an NAD(P)(H)-dependent catalytic activity, with substrate specificity determined by variation of loops on the C-terminal side of the barrel. All the aldo-keto reductases are dependent on nicotinamide cofactors for catalysis and retain a similar cofactor binding site, even among proteins with less than 30% amino acid sequence identity. See Jez J M, et al., *Biochem J* 1997 Sep. 15; 326 (Pt 3):625–36. Rabbit aldose reductase, which catalyzes the conversion of glucose to sorbitol (an organic osmolyte), is induced in renal medullary cells under hyperosmotic conditions. See Ferraris J D, et al., *Proc. Natl. Acad. Sci. USA* 1994 Oct. 25; 91(22):10742-6.

NOV17

A disclosed NOV17 nucleic acid of 884 nucleotides (also referred to as CG55982-01) (SEQ ID NO:53) encoding a novel apolipoprotein A-I-like protein is shown in Table 17A. An open reading frame was identified beginning with an ATG initiation codon at nucleotides 87–89 and ending with a TGA codon at nucleotides 807–809. Putative untranslated regions are found upstream from the initiation codon and downstream from the termination codon, and are underlined. The start and stop codons are shown in bold in Table 17A.

TABLE 17A

NOV17 nucleotide sequence

GAATTCAAAAAAAAAAGAAAAAAAAAAAAAAAAAAAAAAAAAAAAAAGAGAGACTGCGAG (SEQ ID NO:53)
AAGGAGGTCCCCCACGGCCCTTCAGGATGAAAGCTGCGGTGCTGACCTTGGCCGTGCTCT
TCCTGACGGGGAGCCAGGCTCGGCATTTCTGGCAGCAAGATGAACCCCCCCAGAGCCCCT
GGGATCGAGTGAAGGACCTGGCCACTGTGTACGTGGATGTGCTCAAAGACAGCGTGACCT
CCACCTTCAGCAAGCTGCGCGAACAGCTCGGCCCTGTGACCCAGGAGTTCTGGGATAACC
TGGAAAAGGAGACAGAGGGCCTGAGGCAGGAGATGAGCAAGGATCTGGAGGAGGTGAAGG
CCAAGGTGCAGCCCTACCTGGACGACTTCCAGAAGAAGTGGCAGGAGGAGATGGAGCTCT
ACCGCCAGAAGGTGGAGCCGCTGCGCGCAGAGCTCCAAGAGGGCGCGCGCCAGAAGCTGC
ACGAGCTGCAAGAGAAGCTGAGCCCACTGGGCGAGGAGATGCGCGACCGCGCGCGCGCCC
ATGTGGACGCGCTGCGCACGCATCTGGCCCCCTACAGCGACGAGCTGCGCCAGCGCTTGG
CCGCGCGCCTTGAGGCTCTCAAGGAGAACGGCGGCGCCAGACTGGCCGAGTACCACGCCA
AGGCCACCGAGCATCTGAGCACGCTCAGCGAGAAGGCCAAGCCCGCGCTCGAGGACCTCC
GCCAAGGCCTGCTGCCCGTGCTGGAGAGCTTCAAGGTCAGCTTCCTGAGCGCTCTCGAGG
AGTACACTAAGAAGCTCAACACCCAGTGAGGCGCCCGCCGCCGCCCCCCTTCCCGGTGCT
CAGATAAACGTTTCCAAAGTGGGAAAAAAAAAAAAAAGAATTC

The apolipoprotein A-I-like NOV17 disclosed in this invention maps to the long arm of chromosome 11.

In a search of sequence databases, it was found, for example, that the nucleic acid sequence of this invention has 637 of 637 bases (100%) identical to a gb:GENBANK-ID: HUMAPOAIB|acc:M27875.1 mRNA from *Homo sapiens* (Human apolipoprotein A-I mRNA, complete cds).

A disclosed NOV17 polypeptide (SEQ ID NO:54) encoded by SEQ ID NO:53 240 amino acid residues and is presented in Table 17B using the one-letter code. The SignalP, Psort and/or Hydropathy results predict that NOV17 has a signal peptide and is likely to be localized extracellularly with a certainty of 0.3700, as expected by a member of the apolipoprotein A1/A4/E family. In an alternative embodiment, NOV17 is likely to be localized to the endoplasmic reticulum (membrane) with a certainty of 0.1000, or to the endoplasmic reticulum (lumen) with a certainty of 0.1000, or to the microbody (peroxisome) with a certainty of 0.1000. Most likely cleavage site for the signal peptide is between amino acids 18 and 19, i.e., at the dash in the sequence SQA-RH.

TABLE 17B

NOV17 protein sequence

MKAAVLTLAVLFLTGSQARHFWQQDEPPQSPWDRVKDLATVYVDVLKDSVTSTFSKLREQ (SEQ ID NO:54)

LGPVTQEFWDNLEKETEGLRQEMSKDLEEVKAKVQPYLDDFQKKWQEEMELYRQKVEPLR

AELQEGARQKLHELQEKLSPLGEEMRDRARAHVDALRTHLAPYSDELRQRLAARLEALKE

NGGARLAEYHAKATEHLSTLSEKAKPALEDLRQGLLPVLESFKVSFLSALEEYTKKLNTQ

The full amino acid sequence of the protein of the invention was found to have 193 of 193 amino acid residues (100%) identical to, and 193 of 193 amino acid residues (100%) similar to, the 267 amino acid residue ptnr:SWISSPROT-ACC:P02647 protein from *Homo sapiens* (Human) (APOLIPOPROTEIN A-I PRECURSOR (APO-AI))(FIG. 3B). The sequence of this invention lacks 27 internal amino acids when compared to ptnr:SWISSPROT-ACC:P02647 protein from *Homo sapiens* (Human) (APOLIPOPROTEIN A-I PRECURSOR (APO-AI)).

In a search of public sequence databases, NOV17 was found to have homology to the amino acid sequences shown in the BLASTP data listed in Table 17C.

TABLE 17C

BLASTP results for NOV17

| Gene Index/ Identifier | Protein/Organsim | Length (aa) | Identity (%) | Positives (%) | Expect |
|---|---|---|---|---|---|
| ptnr:SWISSPROT-ACC:P02647 | Apolipoprotein A-I precursor (Apo-AI) - *Homo sapiens* | 267 | 193/193 (100%) | 193/193 (100%) | 9.5e-98 |
| ptnr:TREMBLNEW-ACC:AAA51747 | APOA1 PROTEIN - *Homo sapiens* | 249 | 193/193 (100%) | 193/193 (100%) | 9.5e-98 |
| ptnr:REMTREMBL-ACC:CAA00975 | APOA1 PROTEIN - *Homo sapiens* | 243 | 193/193 (100%) | 193/193 (100%) | 9.5e-98 |
| ptnr:REMTREMBL-ACC:CAA03490 | SEQUENCE 10 FROM PATENT WO9G37608 - unidentified | 200 | 192/193 (99%) | 192/193 (99%) | 6.7e-97 |
| ptnr:SWISSPROT-ACC:P15568 | Apolipoprotein A-I precursor (Apo-AI) - *Macaca fascicularis* (Crab eating macaque) (Cynomolgus monkey) | 267 | 186/193 (96%) | 189/193 (97%) | 3.8e-94 |

A multiple sequence alignment is shown in Table 17D, with the protein of the invention being shown on the first line in a ClustalW analysis comparing the protein of the invention with related protein sequences shown in Table 17C.

Table 17D. ClustalW Analysis of NOV17

1) NOV17 CG55982-01 (SEQ ID NO:54)
2) P02647 (SEQ ID NO:219)
3) AAA51747 (SEQ ID NO:220)
4) CAA00975 (SEQ ID NO:221)
5) CAA03490 (SEQ ID NO:222)
6) P15568 (SEQ ID NO:223)

```
                 10        20        30        40        50        60        70        80
            ....|....|....|....|....|....|....|....|....|....|....|....|....|....|....|....|
NOV17       MKAAVLTLAVLFLTGSQARHFWQQDEPPQSPWDRVKDLATVYVDVLKDS------------------------VTST
P02647      MKAAVLTLAVLFLTGSQARHFWQQDEPPQSPWDRVKDLATVYVDVLKDSGRDYVSQFEGSALGKQLNLKLLDNWDSVTST
AAA51747    -----------------RHFWQQDEPPQSPWDRVKDLATVYVDVLKDSGRDYVSQFEGSALGKQLNLKLLDNWDSVTST
CAA00975    ----------------------DEPPQSPWDRVKDLATVYVDVLKDSGRDYVSQFEGSALGKQLNLKLLDNWDSVTST
CAA03490    ----------------------------------------------------------------LKLLDNWDSVTST
P15568      MKATVLTLAVLFLTGSQARHFWQQDEPPQTPWDRVKDLVTVYVEALKDSGKDYVSQFEGSALGKQLNLKLLDNWDSVTST 90       100       110       120       130       140       150       160
            ....|....|....|....|....|....|....|....|....|....|....|....|....|....|....|....|
NOV17       FSKLREQLGPVTQEFWDNLEKETEGLRQEMSKDLEEVKAKVQPYLDDFQKKWQEEMELYRQKVEPLRAELQEGARQKLHE
P02647      FSKLREQLGPVTQEFWDNLEKETEGLRQEMSKDLEEVKAKVQPYLDDFQKKWQEEMELYRQKVEPLRAELQEGARQKLHE
AAA51747    FSKLREQLGPVTQEFWDNLEKETEGLRQEMSKDLEEVKAKVQPYLDDFQKKWQEEMELYRQKVEPLRAELQEGARQKLHE
CAA00975    FSKLREQLGPVTQEFWDNLEKETEGLRQEMSKDLEEVKAKVQPYLDDFQKKWQEEMELYRQKVEPLRAELQEGARQKLHE
CAA03490    FSKLREQLGPVTQEFWDNLEKETEGLRQEMSKDLEEVKAKVQPYLDDFQKKWQEEMELYRQKVEPLRAELQEGARQKLHE
P15568      VSKLREQLGPVTQEFWDNLEKETEGLRQEMSKDLEEVKAKVQPYLDDFQKKWQEEMELYRQKVEPLRAELHEGTRQKLHE 170       180       190       200       210       220       230       240
            ....|....|....|....|....|....|....|....|....|....|....|....|....|....|....|....|
NOV17       LQEKLSPLGEEMRDRARAHVDALRTHLAPYSDELRQRLAARLEALKENGGARLAEYHAKATEHLSTLSEKAKPALEDLRQ
P02647      LQEKLSPLGEEMRDRARAHVDALRTHLAPYSDELRQRLAARLEALKENGGARLAEYHAKATEHLSTLSEKAKPALEDLRQ
AAA51747    LQEKLSPLGEEMRDRARAHVDALRTHLAPYSDELRQRLAARLEALKENGGARLAEYHAKATEHLSTLSEKAKPALEDLRQ
CAA00975    LQEKLSPLGEEMRDRARAHVDALRTHLAPYSDELRQRLAARLEALKENGGARLAEYHAKATEHLSTLSEKAKPALEDLRQ
CAA03490    LQEKLSPLGEEMRDCARAHVDALRTHLAPYSDELRQRLAARLEALKENGGARLAEYHAKATEHLSTLSEKAKPALEDLRQ
P15568      LHEKLSPLGEEVRDRARAHVDALRTHLAPYSDELRQRLAARLEALKENGGARLAEYHAKASEHLSTLSEKAKPALEDLRQ 250       260
            ....|....|....|....|..
NOV17       GLLPVLESFKVSFLSALEEYTKKLNTQ
P02647      GLLPVLESFKVSFLSALEEYTKKLNTQ
AAA51747    GLLPVLESFKVSFLSALEEYTKKLNTQ
CAA00975    GLLPVLESFKVSFLSALEEYTKKLNTQ
CAA03490    GLLPVLESFKVSFLSALEEYTKKLNTQ
P15568      GLLPVLESFKVSFLSALEEYTKKLSTQ
```

Other BLAST results include sequences from the Patp database, which is a proprietary database that contains sequences published in patents and patent publications. Patp results include those listed in Table 17E.

TABLE 17E

Patp BLASTP Analysis for NOV17

| Sequences producing High-scoring Segment Pairs | Protein/Organism | Length (aa) | Identity (%) | Positive (%) | E Value |
|---|---|---|---|---|---|
| patp:AAP61079 | Assumed human apolipoprotein A-1 derivative gene product - *Homo sapiens* | 267 | 193/193 (100%) | 193/193 (100%) | 7.3e-98 |
| patp:AAP82128 | Entire human preproapoprotein A1 - synthetic | 267 | 193/193 (100%) | 193/193 (100%) | 7.3e-98 |
| patp:AAR34032 | Sequence of apo AI - *Homo sapiens* | 267 | 193/193 (100%) | 193/193 (100%) | 7.3e-98 |
| patp:AAR72705 | Human apo A-I including signal and propeptide sequences - *Homo sapiens* | 267 | 193/193 (100%) | 193/193 (100%) | 7.3e-98 |
| patp:AAY18675 | Human apolipoprotein AI protein sequence - *Homo sapiens* | 267 | 193/193 (100%) | 193/193 (100%) | 7.3e-98 |

Table 17F lists the domain description from DOMAIN analysis results against NOV17.

Table 17F. Domain Analysis of NOV17

Pfam analysis

| Model | Domain | seq-f | seq-t | hmm-f | hmm-t | score | E-value |
|---|---|---|---|---|---|---|---|
| KMP11 | 1/1 | 38 | 130 .. | 1 | 90 [] | -6.7 | 7.5 |
| Apolipoprotein | 1/1 | 2 | 238 .. | 1 | 277 [] | 376.2 | 3.3e-109 |

Alignments of top-scoring domains:
KMP11: domain 1 of 1, from 38 to 130: score -6.7, E = 7.5

```
(SEQ ID NO:224)           mAttyEeFaaKLDRLDeEFnkKmeEq...nakFFADKPDest..LsP
                          +|| | +        | +    |   |++||  ++   +
| |  +  |++|
     NOV17     (SEQ ID NO:403) 38    LATVYVDVLK--DSVTSTFS-
KLREQlgpVTQEFWDNLEKETegLRQ 81

EmKEHYEKFEkmiqEHtdKFnKKmrEHsEHFKqKFAEL.LEqqKnAqyP<
                          ||    |    +|   |  | ||  +|  | ++||    |+ |  |  |
                       82 EMSKDLEEVKAKVQPYLDDFQKKWQEEMELYRQKVEPLrAELQEGARQK  130
```

Apolipoprotein: domain 1 of 1, from 2 to 238: score 376.2, E = 3.3e-109

```
(SEQ ID NO:225)           KalvlaLalllLtGcqArsfwQadePEvteqaWqqsqwdqvkdrfwv
                          ||+||+||+|+|||+|||+|||+|||+
||+||+|||+++|
     NOV17     (SEQ ID NO:404) 2    KAAVLTLAVLFLTGSQARHFWQQDEPP-------
QSPWDRVKDLATV 41

YlrqVkdssdqaveqLessqvtqeLnllLednldelksyaeeLqeqLgPv
                          |++  +|||                              +  |++++|+||||||
                       42 YVDVLKDS------------------------VTSTFSKLREQLGPV 64 aqefqarLsKetqalraelgkDlEdvrnrlaPyrdEvqamlgqnleeyRq
                          +|||+++|+|||+  ||+|+  ||||+|+++++||+|++|+++++++|  |||
                       65 TQEFWDNLEKETEGLRQEMSKDLEEVKAKVQPYLDDFQKKWQEEMELYRQ 114 rLePlareLrkrlrrdaeeLqkrLaPyaeelReraernVdalrerLgPyv
                          ++||| +||++++|++++|||++|+|++||+|+||+++||||||++|+||+
                       115 KVEPLRAELQEGARQKLHELQEKLSPLGEEMRDRARAHVDALRTHLAPYS 164
```

```
    EqlRqkaAtlltqrleeLrEraqpyaeEykeqleeqlselReklapvred
    ++|||+     |++|||+|+|++ ++++||++++ |+||+| ||++|++||
165 DELRQR----LAARLEALKENGGARLAEYHAKATEHLSTLSEKAKPALED 210 lqevltpvlEqaQlklqaeafqeelkkkle<-*
    |+++| ||||+  +|+++++++||+ |||+
211 LRQGLLPVLES--FKVSFLSALEEYTKKLN    238
```

The apolipoprotein A-I disclosed in this invention is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus, Colon, Gall Bladder, Liver, Lung, Lymph node, Lymphoid tissue, Ovary, Spleen, Thymus, Whole Organism. This information was derived by determining the tissue sources of the sequences that were included in the invention including but not limited to Seq-Calling sources, Public EST sources, literature sources, and/or RACE sources.

In addition, the sequence is predicted to be expressed in liver because of the expression pattern of (GENBANK-ID: gb:GENBANK-ID:HUMAPOAIB|acc:M27875.1) a closely related Human apolipoprotein A-I mRNA, complete cds homolog in species Homo sapiens.

The nucleic acids and proteins of the invention are useful in potential diagnostic and therapeutic applications implicated in various diseases and disorders described below and/or other pathologies. For example, the compositions of the present invention may have efficacy for treatment of patients suffering from: atherosclerosis, coronary artery disease, other arterial diseases and other diseases, disorders and conditions of the like. The structure of Tangier APOA-I, which fails to associate with HDL, corresponds to that of PRO-APOA-I. This suggests that a faulty conversion of the precursor molecule is responsible for its formation. Tangier disease is characterized by an absence of plasma HDL and accumulation of cholesteryl esters. Milano variant patients have variable amounts of normal versus variant APOA-I, decreased concentrations of HDL, and moderate increases in truglycerides, but no evidence of premature vascular disease. A sequence variant has been identified in amyloid fibrils from patients with polyneuropathic amyloidosis type III (FAP III): the Iowa type variant. Variant ARG-84 causes autosomal dominant amyloidosis. Defects in APOA1 can be the cause of hereditary non-neuropathic systemic amyloidosis (Ostertag-type).

The inverse relationship between high density lipoprotein (HDL) plasma levels and coronary heart disease has been attributed to the role that HDL and its major constituent, apolipoprotein A-I (apoA-I), play in reverse cholesterol transport (RCT). The efficiency of RCT depends on the specific ability of apoA-I to promote cellular cholesterol efflux, bind lipids, activate lecithin:cholesterol acyltransferase (LCAT), and form mature HDL that interact with specific receptors and lipid transfer proteins. From the intensive analysis of apoA-I secondary structure has emerged our current understanding of its different classes of amphipathic alpha-helices, which control lipid-binding specificity. Two models are considered for discoidal lipoproteins formed by association of two apoA-I with phospholipids. In the first or picket fence model, each apoA-I wraps around the disc with antiparallel adjacent alpha-helices and with little intermolecular interactions. In the second or belt model, two antiparallel apoA-I are paired by their C-terminal alpha-helices, wrap around the lipoprotein, and are stabilized by multiple intermolecular interactions. While recent evidence supports the belt model, other models, including hybrid models, cannot be excluded. ApoA-I alpha-helices control lipid binding and association with varying levels of lipids. The N-terminal helix 44–65 and the C-terminal helix 210–241 are recognized as important for the initial association with lipids. In the central domain, helix 100–121 and, to a lesser extent, helix 122–143, are also very important for lipid binding and the formation of mature HDL, whereas helices between residues 144 and 186 contribute little. The LCAT activation domain has now been clearly assigned to helix 144–165 with secondary contribution by helix 166–186. The lower lipid binding affinity of the region 144–186 may be important to the activation mechanism allowing displacement of these apoA-I helices by LCAT and presentation of the lipid substrates. No specific sequence has been found that affects diffusional efflux to lipid-bound apoA-I. In contrast, the C-terminal helices, known to be important for lipid binding and maintenance of HDL in circulation, are also involved in the interaction of lipid-free apoA-I with macrophages and specific lipid efflux. Epidemiological and clinical studies showing an association between decreased concentrations of high-density lipoprotein (HDL) cholesterol and increased risk of premature coronary artery disease have generated interest in the mechanism through which HDL prevents atherosclerosis. Recognition of the importance of apolipoproteins (apo(s)) has led to the separation of HDL into subpopulations according to their apolipoprotein composition. It is now recognised that HDL comprises at least two types of apo A-I-containing lipoproteins: LpA-I:A-II containing both apo A-I and apo A-II and LpA-I containing apo A-I but not apo A-II. A majority of studies support the fact that LpA-I is more effective than LpA-I:A-II in promoting cellular cholesterol efflux, the first step in reverse cholesterol transport. Studies in transgenic animals have revealed that the gene transfer of human apo A-I in mice and rabbits increases plasma apo A-I and HDL cholesterol levels and particularly apo A-I-rich HDL particle concentrations, leading to inhibition of the development of dietary or genetically induced atherosclerosis. On the other hand, gene transfer of apo A-II in mice gives conflicting results. The conclusions of some experiments indicate either an atherogenic, or a poorly anti-atherogenic, or even a strongly anti-atherogenic role for apo A-II and for apo A-II-rich HDL lipoproteins. Although these experimental results have been obtained in animals, they confirm previous studies obtained in human clinical studies, indicating that apo A-I-rich HDL (tested as LpA-I in clinical studies) are generally strong plasma markers of atherosclerosis protection while the clinical significance of apo A-I+ apo A-II HDL (tested as LpA-I:A-II in clinical studies) is more controversial. Over the past few years, new experimental approaches have reinforced the awareness among investigators that the heterogeneity of HDL particles indicates significant differences in production and catabolism of HDL particles. Recent kinetic studies have suggested that small HDL, containing two apolipoprotein A-I molecules per particle, are converted in a unidirectional manner to medium HDL or large HDL, containing three or four apolipoprotein A-I molecules per particle, respectively. Conversion appears to occur in close physical proximity with cells and not while HDL particles circulate in plasma. The medium and large HDL are terminal particles in HDL metabolism with large HDL, and perhaps medium HDL, being catabolized primarily by the liver. These kinetic studies of HDL subfraction metabolism are compelling in-vivo data that are consistent with the proposed role of HDL in reverse cholesterol transport. The protein components of human lipoproteins, apolipoproteins, allow the redistribution of cholesterol from the arterial wall to other tissues and exert beneficial effects on systems involved in the development of arterial lesions, like inflammation and hemostasis. Because of these properties, the antiatherogenic apolipoproteins, particularly apo A-I and apo E, may provide an innovative approach to the management of vascular diseases. The recent availability of extractive or biosynthetic molecules is allowing a detailed overview of their therapeutic potential in a number of animal models of arterial disease. Infusions of apo E, or more dramatically, of apo A-I, both recombinant or extractive, cause a direct reduction of the atherosclerotic burden in experimental animals. Naturally, as the apo A-I(Milano) (apo A-I(M)) dimer, or engineered recombinant apolipoproteins with prolonged permanence in plasma and improved function may offer an even better approach to the therapeutic handling of arterial disease. This progress will go on in parallel with innovations in the technologies for direct, non invasive assessments of human atherosclerosis, thus allowing closer monitoring of this potential new approach to therapy.

NOV18

A disclosed NOV18 nucleic acid of 751 nucleotides (also referred to as CG56747-02) (SEQ ID NO:55) encoding a novel Apolipoprotein A-1 Precursor-like protein is shown in Table 18A. An open reading frame was identified beginning with an ATG initiation codon at nucleotides 87–89 and ending with a TGA codon at nucleotides 708–710. Putative untranslated regions are found upstream from the initiation codon and downstream from the termination codon, and are underlined. The start and stop codons are in bold in Table 18A.

In a search of sequence databases, it was found, for example, that the nucleic acid sequence of this invention has 424 of 521 bases (81%) identical to a gb:GENBANK-ID: HSAPOAIT|acc:X07496.1 mRNA from *Homo sapiens* (Human Tangier apoA-I gene).

A disclosed NOV18 polypeptide (SEQ ID NO:56) encoded by SEQ ID NO:55 has 207 amino acid residues and is presented in Table 18B using the one-letter code. NOV18 polypeptides are likely Type IIIb (Nexo Ccyt) membrane proteins. The SignalP, Psort and/or Hydropathy results predict that NOV18 has a signal peptide and is likely to be localized extracellularly with a certainty of 0.3700. In an alternative embodiment, NOV18 is likely to be localized to the microbody (peroxisome) with a certainty of 0.1129, or to the endoplasmic reticulum membrane with a certainty of 0.1000, or to the endoplasmic reticulum (lumen) with a certainty of 0.1000. The signal peptide is predicted by SignalP to be cleaved between amino acids 18 and 19, i.e., at the dash in the sequence SQA-RH.

TABLE 18A

NOV18 nucleotide sequence

GAATTCAAAAAAAAAAGAAAAAAAAAAAAAAAAAAAAAAAAAAAAAAAGAGAGACTGCGAG (SEQ ID NO:55)

AAGGAGGTCCCCCACGGCCCTTCAGGATGAAAGCTGCGGTGCTGACCTTGGCCGTGCTCT

TCCTGACGGGGAGCCAGGCTCGGCATTTCTGGCAGCAAGATGAACCCCCCCAGAGCCCCT

GGGATCGAGTGAAGGACCTGGCCACTGTGTACGTGGATGTGCTCAAGGACAGCGTGACCT

CCACCTTCAGCAAGCTGCGCGAACAGCTCGGCCCTGTGACCCAGGAGTTCTGGGATAACC

TGGAAAAGGAGACAGAGGGCCTGAGGCAGGAGATGAGCAAGGATCTGGAGGAGGTGAAGG

CCAAGGTGCAGCCCTACCTGGACGACTTCCAGAAGAAGTGGCAGGAGGAGATGGAGCTCT

ACCGCCAGAAGGTGGAGCCGCTGCGCGCAGAGCTCCAAGAGGGCGCGCGCCAGAAGCTGC

ACGAGCTGCGCCAGCGCTTGGCCGAGCGCCTTGAGGCTCTCAAGGAGAACGGCGGCGCCA

GACTGGCCGAGTACCACGCCAAGGCCACCGAGCATCTGAGCACGCTCAGCGAGAAGGCCA

AGCCCGCGCTCGAGGACCTCCGCCAAGGCCTGCTGCCCGTGCTGGAGAGCTTCAAGGTCA

GCTTCCTGAGCGCTCTCGAGGAGTACACTAAGAAGCTCAACACCCAGTGAGGCGCCCGCC

GCCGCCCCCCTTCCCGGTGCTCAGAATAAAC

TABLE 18B

NOV18 protein sequence

MKAAVLTLAVLFLTGSQARHFWQQDEPPQSPWDRVKDLATVYVDVLKDSVTSTFSKLREQ (SEQ ID NO:56)

LGPVTQEFWDNLEKETEGLRQEMSKDLEEVKAKVQPYLDDFQKKWQEEMELYRQKVEPLR

AELQEGARQKLHELRQRLAERLEALKENGGARLAEYHAKATEHLSTLSEKAKPALEDLRQ

GLLPVLESFKVSFLSALEEYTKKLNTQ

NOV18 is an internal splice variant of the previously identified sequence NOV17 (Accession Number CG55982-01). The relationship between the NOV17 and NOV18 protein sequences is shown in Table 18C.

Table 18C. ClustalW Alignment of NOV17 and NOV18

```
              10        20        30        40        50        60        70        80
         ....|....|....|....|....|....|....|....|....|....|....|....|....|....|....|....|
CG55982_01  MKAAVLTLAVLFLTGSQARHFWQQDEPPQSPWDRVKDLATVYVDVLKDSVTSTFSKLREQLGPVTQEFWDNLEKETEGLR
CG56747_02  MKAAVLTLAVLFLTGSQARHFWQQDEPPQSPWDRVKDLATVYVDVLKDSVTSTFSKLREQLGPVTQEFWDNLEKETEGLR 90       100       110       120       130       140       150       160
         ....|....|....|....|....|....|....|....|....|....|....|....|....|....|....|....|
CG55982_01  QEMSKDLEEVKAKVQPYLDDFQKKWQEEMELYRQKVEPLRAELQEGARQKLHELQEKLSPLGEEMRDRARAHVDALRTHL
CG56747_02  QEMSKDLEEVKAKVQPYLDDFQKKWQEEMELYRQKVEPLRAELQEGARQKLHEL--------------------------

170       180       190       200       210       220       230       240
         ....|....|....|....|....|....|....|....|....|....|....|....|....|....|....|....|
CG55982_01  APYSDELRQRLAARLEALKENGGARLAEYHAKATEHLSTLSEKAKPALEDLRQGLLPVLESFKVSFLSALEEYTKKLNTQ
CG56747_02  -------RQRLAARLEALKENGGARLAEYHAKATEHLSTLSEKAKPALED 220       230       240
         ....|....|....|....|....|....|
CG55982_01  LRQGLLPVLESFKVSFLSALEEYTKKLNTQ  (SEQ ID NO:54)
CG56747_02  LRQGLLPVLESFKVSFLSALEEYTKKLNTQ  (SEQ ID NO:56)
```

The full amino acid sequence of the NOV18 protein of the invention was found to have 104 of 156 amino acid residues (66%) identical to, and 118 of 156 amino acid residues (75%) similar to, the 267 amino acid residue ptnr:SWIS-SPROT-ACC:P02647 protein from *Homo sapiens* (Human) (APOLIPOPROTEIN A-I PRECURSOR (APO-AI)).

In a search of public sequence databases, NOV18 was found to have homology to the amino acid sequences shown in the BLASTP data listed in Table 18D.

TABLE 18D

BLASTP results for NOV18

| Gene Index/ Identifier | Protein/Organism | Length (aa) | Identity (%) | Positives (%) | Expect |
|---|---|---|---|---|---|
| ptnr:SWISSPROT-ACC:P02647 | Apolipoprotein A-I precursor (Apo-AI) - *Homo sapiens* | 267 | 104/156 (66%) | 118/156 (75%) | 3.8e-46 |
| ptnr:TREMBLNEW-ACC:AAA51747 | APOA1 PROTEIN - *Homo sapiens* | 249 | 104/156 (66%) | 118/156 (75%) | 3.8e-46 |
| ptnr:REMTREMBL-ACC:CAA00975 | APOA1 PROTEIN - *Homo sapiens* | 243 | 104/156 (66%) | 118/156 (75%) | 3.8e-46 |
| ptnr:REMTREMBL-ACC:CAA03490 | SEQUENCE 10 FROM PATENT WO9637608 - unidentified | 200 | 105/156 (67%) | 119/156 (76%) | 1.0e-45 |
| ptnr:SWISSPROT-ACC:P15568 | Apolipoprotein A-I precursor (Apo-AI) - *Macaca fascicularis* (Crab eating macaque) (Cynomolgus monkey) | 267 | 104/156 (66%) | 112/156 (71%) | 2.4e-44 |

A multiple sequence alignment is shown in Table 18E, with the protein of the invention being shown on the first line in a ClustalW analysis comparing the protein of the invention with related protein sequences shown in Table 18D.

Table 18E. ClustalW Analysis of NOV18

1) NOV18 CG56747-02 (SEQ ID NO:56)
2) P02647 (SEQ ID NO:226)
3) AAA51747 (SEQ ID NO:227)
4) CAA00975 (SEQ ID NO:228)
5) CAA03490 (SEQ ID NO:229)
6) P15568 (SEQ ID NO:230)

```
                 10        20        30        40        50        60        70        80
           ....|....|....|....|....|....|....|....|....|....|....|....|....|....|....|....|
NOV18      MKAAVLTLAVLFLTGSQARHFWQQDEPPQSPWDRVKDLATVYVDVLK-----------------------DSVTST
P02647     MKAAVLTLAVLFLTGSQARHFWQQDEPPQSPWDRVKDLATVYVDVLKDSGRDYVSQFEGSALGKQLNLKLLDNWDSVTST
AAA51747   ------------------RHFWQQDEPPQSPWDRVKDLATVYVDVLKDSGRDYVSQFEGSALGKQLNLKLLDNWDSVTST
CAA00975   ----------------------DEPPQSPWDRVKDLATVYVDVLKDSGRDYVSQFEGSALGKQLNLKLLDNWDSVTST
CAA03490   ----------------------------------------------------------------LKLLDNWDSVTST
P15568     MKATVLTLAVLFLTGSQARHFWQQDEPPQIPWDRVKDLVTVYVEALKDSGRDYVSQFEGSALGKQLNLKLLDNWDSVTST 90       100       110       120       130       140       150       160
           ....|....|....|....|....|....|....|....|....|....|....|....|....|....|....|....|
NOV18      FSKLREQLGPVTQEFWDNLEKETEGLRQEMSKDLEEVKAKVQPYLDDFQKKWQEEMELYRQKVEPLRAELQEGARQKLHE
P02647     FSKLREQLGPVTQEFWDNLEKETEGLRQEMSKDLEEVKAKVQPYLDDFQKKWQEEMELYRQKVEPLRAELQEGARQKLHE
AAA51747   FSKLREQLGPVTQEFWDNLEKETEGLRQEMSKDLEEVKAKVQPYLDDFQKKWQEEMELYRQKVEPLRAELQEGARQKLHE
CAA00975   FSKLREQLGPVTQEFWDNLEKETEGLRQEMSKDLEEVKAKVQPYLDDFQKKWQEEMELYRQKVEPLRAELQEGARQKLHE
CAA03490   FSKLREQLGPVTQEFWDNLEKETEGLRQEMSKDLEEVKAKVQPYLDDFQKKWQEEMELYRQKVEPLRAELQEGARQKLHE
P15568     VSKLREQLGPVTQEFWDNLEKETEGLRQEMSKDLEEVKAKVQPYLDDFQKKWQEEMELYRQKVEPLRAELHEGTRQKLHE 170       180       190       200       210       220       230       240
           ....|....|....|....|....|....|....|....|....|....|....|....|....|....|....|....|
NOV18      L-----------------------RQRLAERLEALKENGGARLAEYHAKATEHLSTLSEKAKPALEDLRQ
P02647     LQEKLSPLGEEMRDRARAHVDALRTHLAPYSDELRQRLAARLEALKENGGARLAEYHAKATEHLSTLSEKAKPALEDLRQ
AAA51747   LQEKLSPLGEEMRDRARAHVDALRTHLAPYSDELRQRLAARLEALKENGGARLAEYHAKATEHLSTLSEKAKPALEDLRQ
CAA00975   LQEKLSPLGEEMRDRARAHVDALRTHLAPYSDELRQRLAARLEALKENGGARLAEYHAKATEHLSTLSEKAKPALEDLRQ
CAA03490   LQEKLSPLGEEMRDCARAHVDALRTHLAPYSDELRQRLAARLEALKENGGARLAEYHAKATEHLSTLSEKAKPALEDLRQ
P15568     LHEKLSPLGEEVRDRARAHVDALRTHLAPYSDELRQRLAARLEALKENGGARLAEYHAKASEHLSTLSEKAKPALEDLRQ 250       260
           ....|....|....|....|..
NOV18      GLLPVLESFKVSFLSALEEYTKKLNTQ
P02647     GLLPVLESFKVSFLSALEEYTKKLNTQ
AAA51747   GLLPVLESFKVSFLSALEEYTKKLNTQ
CAA00975   GLLPVLESFKVSFLSALEEYTKKLNTQ
CAA03490   GLLPVLESFKVSFLSALEEYTKKLNTQ
P15568     GLLPVLESFKVSFLSALEEYTKKLSTQ
```

Other BLAST results include sequences from the Patp database, which is a proprietary database that contains sequences published in patents and patent publications. Patp results include those listed in Table 18F.

TABLE 18F

Patp BLASTP Analysis for NOV18

| Sequences producing High-scoring Segment Pairs | Protein/Organism | Length (aa) | Identity (%) | Positive (%) | E Value |
|---|---|---|---|---|---|
| patp:AAP61079 | Assumed human apolipoprotein A-1 derivative gene product - *Homo sapiens* | 261 | 104/156 (66%) | 118/156 (75%) | 3.0e-46 |
| patp:AAP82128 | Entire human preproapoprotein A1 - synthetic | 267 | 104/156 (66%) | 118/156 (75%) | 3.0e-46 |
| patp:AAR34032 | Sequence of apo AI - *Homo sapiens* | 267 | 104/156 (66%) | 118/156 (75%) | 3.0e-46 |
| patp:AAR72705 | Human apo A-I including signal and propeptide sequences - *Homo sapiens* | 267 | 104/156 (66%) | 118/156 (75%) | 3.0e-46 |
| patp:AAY18675 | Human apolipoprotein AI protein sequence - *Homo sapiens* | 267 | 104/156 (66%) | 118/156 (75%) | 3.0e-46 |

Table 18G lists the domain description from DOMAIN analysis results against NOV18.

Table 18G. Domain Analysis of NOV18

Pfam analysis

| Model | Domain | seq-f | seq-t | hmm-f | hmm-t | score | E-value |
|---|---|---|---|---|---|---|---|
| KMP11 | 1/1 | 38 | 130 .. | 1 | 90 [] | -6.7 | 7.5 |
| Apolipoprotein | 1/1 | 2 | 205 .. | 1 | 277 [] | 256.2 | 4.4e-73 |

Alignments of top-scoring domains:
KMP11: domain 1 of 1, from 38 to 130: score -6.7, E = 7.5

```
    (SEQ ID NO:231)            mAttyEeFaaKLDRLDeEFnkKmeEq...nakFFADKPDest...LsP
                                  +|| | +       | +    |  |++||  ++  +
  | |  +  |++|
       NOV18     (SEQ ID NO:405) 38   LATVYVDVLK--DSVTSTFS-
KLREQlgpVTQEFWDNLEKETegLRQ 81

EmKEHYEKFEkmiqEHtdKFnKKmrEHsEHFKqKFAEL.LEqqKnAqyP<
                                ||      |    +|   |  | || +|   | ++||    |+ | | |
                            82 EMSKDLEEVKAKVQPYLDDFQKKWQEEMELYRQKVEPLrAELQEGARQK    130
```

Apolipoprotein: domain 1 of 1, from 2 to 205: score 256.2, E = 4.4e-73

```
    (SEQ ID NO:232)           KalvlaLalllLtGcqArsfwQadePEvteqaWqqsqwdqvkdrfwv
                               ||+||+|||+|+|+|||+|||+|||+|||+
  ||+||+|||+++|
       NOV18    (SEQ ID NO:406) 2     KAAVLTLAVLFLTGSQARHFWQQDEPP-------
QSPWDRVKDLATV 41

YlrqVkdssdqaveqLessqvtqeLnllLednldelksyaeeLqeqLgPv
                              |++ +|||                                + |++++|+||||||
                           42 YVDVLKDS----------------------VTSTFSKLREQLGPV 64 aqefqarLsKetqalraelgkDlEdvrnrlaPyrdEvqamlgqnleeyRq
                              +|||+++|+|||+  ||+|+  ||||+|+++++[]+|+++|+++++++|  |||
                           65 TQEFWDNLEKETEGLRQEMSKDLEEVKAKVQPYLDDFQKKWQEEMELYRQ 114 rLePlareLrkrlrrdaeeLqkrLaPyaeelReraernVdalrerLgPyv
```

```
                ++|||  +||++++|++++||
        115     KVEPLRAELQEGARQKLHEL-----------------------------  134

EqlRqkaAtlltqrleeLrEraqpyaeEykeqleeqlselReklapvred
                ||+    |++|||+|+|++ ++++||++++ |+||+| ||++|++||
        135     ---RQR----LAERLEALKENGGARLAEYHAKATEHLSTLSEKAKPALED  177 lqevltpvlEqaQlklqaeafqeelkkkle<-*
                |+++|  ||||+  +|++++++++||+ |||+
        178     LRQGLLPVLES--FKVSFLSALEEYTKKLN          205
```

IPR000074: Human apolipoprotein E, a blood plasma protein, mediates the transport and uptake of cholesterol and lipid by way of its high affinity interaction with different cellular receptors, including the low-density lipoprotein (LDL) receptor. The three-dimensional structure of the LDL receptor-binding domain of apoE indicates that the protein forms an unusually elongated four-helix bundle that may be stabilized by a tightly packed hydrophobic core that includes leucine zipper-type interactions and by numerous salt bridges on the mostly charged surface. Basic amino acids important for LDL receptor binding are clustered into a surface patch on one long helix.

The sequence is predicted to be expressed in the following tissues because of the expression pattern of (GENBANK-ID: gb:GENBANK-ID:HSAPOAITIacc:X07496.1) a closely related Human Tangier apoA-I gene homolog in species Homo sapiens:lymphocyte.

The nucleic acids and proteins of the invention have applications in the diagnosis and/or treatment of various diseases and disorders. For example, the compositions of the present invention will have efficacy for the treatment of patients suffering from: dysbetalipoproteinemia, hyperlipoproteinemia type III, atherosclerosis, xanthomatosis and premature coronary and/or peripheral vascular disease, hypothyroidism, systemic lupus erythematosus, diabetic acidosis, hypercholesterolemia, planar and tendon xanthomas, dysbetalipoproteinemia, hypercholesterolemia, premature cardiovascular disease, accelerated vascular disease, Alzheimer Disease, familial amyloidotic polyneuropathy, Down syndrome and other neurological disorders as well as other diseases, disorders and conditions.

Utermann et al. (Clin. Genet. 15: 63–72, 1979) described 2 phenotypes, apoE(IV+) and apoE(IV−), differentiated by analytical isoelectric focusing. They concluded that this polymorphism of apolipoprotein E in human serum is determined by 2 autosomal codominant alleles, apoE(n) and apoE(d). Homozygosity for the latter results in primary dysbetalipoproteinemia but only some persons develop gross hyperlipidemia (hyperlipoproteinemia type III). Vertical transmission is pseudodominance due to high frequency of the apoE(d) gene (Utermann et al., 1979). Dysbetalipoproteinemia is already expressed in childhood. They concluded that primary dysbetalipoproteinemia is a frequent monogenic variant of lipoprotein metabolism, but not a disease. Coincidence of the genes for this dyslipoproteinemia with any of the genes for monogenic or polygenic forms of familial hyperlipemia results in hyperlipoproteinemia type III. Further complexities of the genetics of the apolipoprotein E system were discussed by Utermann et al. (Am. J. Hum. Genet. 32: 339–347, 1980). Apolipoprotein E (apoE) of very low density lipoprotein (VLDL) from different persons shows 1 of 2 complex patterns, termed alpha and beta (Zannis et al., 1981). Three subclasses of each pattern were found and designated alpha-II, alpha-III and alpha-IV and beta-II, beta-III and beta-IV. From family studies, Zannis et al. (Am. J. Hum. Genet. 33: 11–24, 1981) concluded that a single locus with 3 common alleles is responsible for these patterns. The alleles were designated epsilon-II, -III, and -IV. The authors further concluded that beta class phenotypes represent homozygosity for one of the epsilon alleles, e.g., beta-II results from homozygosity for the epsilon-II allele. In contrast, the alpha phenotypes are thought to represent compound heterozygosity, i.e., heterozygosity for 2 different epsilon alleles: alpha II from epsilon II and III; alpha III from epsilon III and IV. The frequency of the epsilon II, III, and IV alleles was estimated at 0.11, 0.72, and 0.17, respectively. ApoE subclass beta-IV was found to be associated with type III hyperlipoproteinemia. Rall et al. (J. Biol. Chem. 257: 4171–4178, 1982) published the full amino acid sequence. Mature apoE is a 299-amino acid polypeptide.

The 3 major isoforms of human apolipoprotein E (apoE2, -E3, and -E4), as identified by isoelectric focusing, are coded for by 3 alleles (epsilon 2, 3, and 4). The E2 (107741.0001), E3 (107741.0015), and E4 (107741.0016) isoforms differ in amino acid sequence at 2 sites, residue 112 (called site A) and residue 158 (calledsite B). At sites A/B, apoE2, -E3, and -E4 contain cysteine/cysteine, cysteine/arginine, and arginine/arginine, respectively (Weisgraber et al., J. Biol. Chem. 256: 9077–9083, 1981; Rall et al., Proc. Nat. Acad. Sci. 79: 4696–4700, 1982). The 3 forms have 0, 1+, and 2+ charges to account for electrophoretic differences (Margolis, 1982). (The nomenclature of the apolipoprotein E isoforms, defined by isoelectric focusing, has gone through an evolution.) E3 is the most frequent ('wildtype') isoform. As reviewed by Smit et al. (J. Lipid Res. 31: 45–53, 1990), E4 differs from E3 by a cys-to-arg change at position 112 and is designated E4(cys112-to-arg). Four different mutations giving a band at the E2 position with isoelectric focusing have been described: E2(arg158-to-cys), E2(lys146-to-gln), E2(arg145-to-cys) and E2-Christchurch(arg136-to-ser). E2(arg158-to-cys) is the most common of the 4.

In a comprehensive review of apoE variants, de Knijff et al. (Clin. Invest. 88: 643–655, 1994) found that 30 variants had been characterized, including the most common variant, apoE3. To that time, 14 apoE variants had been found to be associated with familial dysbetalipoproteinemia, characterized by elevated plasma cholesterol and triglyceride levels and an increased risk for atherosclerosis.

Data on gene frequencies of apoE allelic variants were tabulated by Roychoudhury and Nei (New York: Oxford Univ. Press (pub.) 1988). Gerdes et al. (Genet. Epidemiol. 9:155–167, 1992) and Gerdes et al. (Hum. Genet. 98: 546–550, 1996) reported the frequency of apoE polymorphisms in the Danish population and in Greenland Inuit, respectively, in relation to the findings in 45 other study populations around the world.

In normal individuals, chylomicron remnants and very low density lipoprotein (VLDL) remnants are rapidly removed from the circulation by receptor-mediated endocytosis in the liver. In familial dysbetalipoproteinemia, or type III hyperlipoproteinemia (HLP III), increased plasma cholesterol and triglycerides are the consequence of impaired clearance of chylomicron and VLDL remnants because of a defect in apolipoprotein E. Accumulation of the remnants can result in xanthomatosis and premature coronary and/or peripheral vascular disease. Hyperlipoproteinemia III can be either due to primary heritable defects in apolipoprotein metabolism or secondary to other conditions such as hypothyroidism, systemic lupus erythematosus, or diabetic acidosis. Most patients with familialdysbetalipoproteinemia (HLP III) are homozygous for the E2 isoform (J. Lipid Res. 23: 1224–1235, Breslow et al., 1982). Only rarely does the disorder occur with the heterozygous phenotypes E3E2 or E4E2. The E2 isoform shows defective binding of remnants to hepatic lipoprotein receptors (Schneider et al., J. Clin. Invest. 68: 1075–1085, 1981; Rall et al., Proc. Nat. Acad. Sci. 79: 4696–4700, 1982) and delayed clearance from plasma (Gregg et al., Science 211: 584–586, 1981). Additional genetic and/or environmental factors must be required for development of the disorder, however, because only 1–4% of E2E2 homozygotes develop familial dysbetalipoproteinemia. Since the defect in this disorder involves the exogenous cholesterol transport system, the degree of hypercholesterolemia is sensitive to the level of cholesterol in the diet (Brown et al., Science 212: 628–635, 1981). Even on a normal diet, the patient may show increased plasma cholesterol and the presence of an abnormal lipoprotein called beta-VLDL. VLDL in general is markedly increased while LDL is reduced.

Carbohydrate induces or exacerbates the hyperlipidemia, resulting in marked variability in plasma levels and ready therapy through dietary means. Often tuberous and planar and sometimes tendon xanthomas occur as well as precocious atherosclerosis and abnormal glucose tolerance. Tuberous and tuberoeruptivexanthomas are particularly characteristic. Hazzard (1978) demonstrated the eliciting effects of electric shock in a man revived from accidental electrocution and later showing striking xanthomas of the palms. Development of the phenotype is age dependent, being rarely evident before the third decade. The nosography of the type III hyperlipoproteinemia phenotype up to 1977 was reviewed by Levy and Morganroth (Ann. Intern. Med. 87: 625–628, 1977). Subsequent description of specific biochemical alterations in apolipoprotein structure and metabolism has proven this phenotype to be genetically heterogeneous. In the first application of apoprotein immunoassay to this group of disorders, Kushwaha et al. (Ann. Intern. Med. 87: 517–525, 1977) found that apolipoprotein E (arginine-rich lipoprotein) is high in the VLD lipoproteins of type III. They also found that exogenous estrogen, which stimulates triglyceride production in normal women and those with endogenous hypertriglyceridemia, exerted a paradoxical hypotriglyceridemic effect in this disorder (Kushwaha et al., 1977). The abnormal pattern of apoE by isoelectric focusing (IEF), specifically, the absence of apoE3, is the most characteristic biochemical feature of HLP III. Gregg et al. (1981) showed that apoE isolated from subjects with type III HLP had a decreased fractional catabolic rate in vivo in both type III HLP patients and normal persons.

Hazzard et al. (Metabolism 30: 79–88, 1981) reported on the large O'Donnell kindred, studied because of a proband with type III HLP. They studied specifically the VLDL isoapolipoprotein E distributions. The findings confirmed earlier work indicating that the ratio of E3 to E2 is determined by two apoE3 alleles, designated d and n, which produce three phenotypes, apoE3-d, apoE3-nd, and apoE3-n, corresponding to the low, intermediate, and high ratios. Ghiselli et al. (Science 214: 1239–1241, 1981) studied a black kindred with type III HLP due to deficiency of apolipoprotein E. No plasma apolipoprotein E could be detected. Other families with type III HLP have had increased amounts of an abnormal apoE. In addition, the patients of Ghiselli et al. (1981) had only mild hypertriglyceridemia, increased LDL cholesterol, and a much higher ratio of VLDL cholesterol to plasma triglyceride than reported in other type III HLP families. The proband was a 60-year-old woman with a 10-year history of tuberoeruptive xanthomas of the elbows and knees, a 3-year history of angina pectoris, and 80% narrowing of the first diagonal coronary artery by arteriography. Her father had xanthomas and died at age 62 of myocardial infarction. Her mother was alive and well at age 86. Three of 7 sibs also had xanthomas; her 2 offspring had no xanthomas. The evidence suggests that apoE is important for the catabolism of chylomicron fragments. The affected persons in the family studied by Ghiselli et al. (1981) had plasma levels of apoE less than 0.05 mg/dl by radioimmunoassay, and no structural variants of apoE were detected by immunoblot of plasma or VLDL separated by 2-dimensional gel electrophoresis. Anchors et al. (Biochem. Biophys. Res. Commun. 134: 937–943, 1986) reported that the apoE gene was present in the apoE-deficient patient and that there were no major insertions or deletions in the gene by Southern blot analysis. Blood monocyte-macrophages isolated from a patient contained levels of apoE mRNA 1 to 3% of that present in monocyte-macrophages isolated from normal subjects. The mRNA from the patient appeared to be of normal size. Anchors et al. (1986) suggested that the decreased apoE mRNA might be due to a defect in transcription or processing of the primary transcript or to instability of the apoE mRNA. The decreased plasma level of apoE resulted in delayed clearance of remnants of triglyceride-rich lipoproteins, hyperlipidemia, and the phenotype of type III HLP. In the kindred with apolipoprotein E deficiency studied by Ghiselli et al. (1981), the defect was shown by Cladaras et al. (J. Biol. Chem. 262: 2310–2315, 1987) to involve an acceptor splice site mutation in intron 3 of the APOE gene (107741.0005). ApoE, a main apoprotein of the chylomicron, binds to a specific receptor on liver cells and peripheral cells. The E2 variant binds less readily. A defect in the receptor for apoE on liver and peripheral cells might also lead to dysbetalipoproteinemia, but such has not been observed. Weisgraber et al. (Biol. Chem. 257: 2518–2521, 1982) showed that human E apoprotein of the E2 form, which contains cysteine (rather than arginine) at both of the 2 variable sites, binds poorly with cell surface receptors, whereas E3 and E4 bind well. They postulated that a positively charged residue at variable site B is important for normal binding. To test the hypothesis, they treated E2 apoE with cysteamine to convert cysteine to a positively charged lysine analog. This resulted in a marked increase in the binding activity of the E2 apoE. Although nearly every type III hyperlipoproteinemic person has the E2/E2 phenotype, 95 to 99% of persons with this phenotype do not have type III HLP nor do they have elevated plasma cholesterol levels. Rall et al. (J. Clin. Invest. 72: 1288–1297, 1983) showed that apoE2 of hypo-, normo-, and hypercholesterolemic subjects showed the same severe functional abnormalities. Thus, factors in addition to the defective receptor binding activity of the apoE2 are necessary for manifestation of type III HLP. A variety of factors exacerbate or modulate type III. In women, it most often occurs after the menopause and in such patients is particularly sensitive to estrogen therapy. Hypothyroidism exacerbates type III and thyroid hormone is known to enhance receptor-mediated lipoprotein metabolism. Obesity, diabetes and age are associated with increased hepatic synthesis of VLDL and/or cholesterol; occurrence of type III in E2/E2 persons with these factors may be explained thereby. Furthermore, the defect in familial combined HLP (144250), which is, it seems, combined with E2/E2 in the production of type III (Utermann et al., 1979; Hazzard et al., 1981), may be hepatic overproduction of cholesterol and VLDL. As pointed out by Brown and Goldstein (J. Clin. Invest. 72: 743–747, 1983), familial hypercholesterolemia (FH) is a genetic defect of the LDL receptor (LDLR; 143890), whereas familial dysbetalipoproteinemia is a genetic defect in a ligand. The puzzle that all apoE2/2 homozygotes do not have extremely high plasma levels of IDL and chylomicron remnants (apoE-containing lipoproteins) may be solved by the observation that the lipoprotein levels in these patients are exquisitely sensitive to factors that reduce hepatic LDL receptors, e.g., age, decreased levels of thyroid hormone and estrogen, and the genetic defect of FH. Presumably, high levels of hepatic LDL receptors can compensate for the genetic binding defect of E2 homozygotes. Gregg et al. (Lancet I: 353, 1983) suggested that apoE4 is associated with severe type V hyperlipoproteinemia in a manner comparable to the association of apoE2 with type III. Vogel et al. (Proc. Nat. Acad. Sci. 82: 8696–8700, 1985) showed that large amounts of apoE can be produced by E. coli transformed with a plasmid containing a human apoE cDNA. The use in studies of structure-function relationships through production of site-specific mutants was noted. Wardell et al. (J. Biol. Chem. 264: 21205–21210, 1989) demonstrated that the defect is a 7-amino acid insertion that represents a tandem repeat of amino acid residues 121–127 resulting in the normal protein having 306 amino acids rather than the normal 299. Schaefer et al. (J. Clin. Invest. 78: 1206–1219, 1986) described a unique American black kindred with premature cardiovascular disease, tuberoeruptive xanthomas, and type III HLP associated with familial apolipoprotein E deficiency. Four homozygotes had marked increases in cholesterol-rich, very low density lipoproteins and intermediate density lipoproteins (IDL). Homozygotes had only trace amounts of plasma apoE, and accumulations of apoB-48 (107730) and apoA-4 (107690) in VLDL, IDL, and low density lipoproteins. Obligate heterozygotes generally had normal plasma lipids and mean plasma apoE concentrations that were 42% of normal. The findings indicated that apoE is essential for the normal catabolism of triglyceride-rich lipoprotein constituents. It had been shown that cultured peripheral blood monocytes synthesized low amounts of 2 aberrant forms of apoE mRNA but produced no immunoprecipitable forms of apoE. The expression studies were done comparing the normal and abnormal APOE genes transfected into mouse cells in combination with the mouse metallothionein I promoter. Bersot et al. (J. Clin. Invest. 72: 1024–1033, 1983) studied atypical dysbetalipoproteinemia characterized by severe hypercholesterolemia and hypertriglyceridemia, xanthomatosis, premature vascular disease, the apoE3/3 phenotype (rather than the classic E2/2 phenotype), and a preponderance of beta-VLDL. They showed that the beta-VLDL from these subjects stimulated cholesteryl ester accumulation in mouse peritoneal macrophages. They suggested that the accelerated vascular disease results from this uptake by macrophages which are converted into the foam cells of atherosclerotic lesions. Smit et al. (Clin. Genet. 32: 335–341, 1987) described 3 out of 41 Dutch dysbetalipoproteinemic patients who were apparent E3/E2 heterozygotes rather than the usual E2/E2 homozygotes. All 3 genetically unrelated patients showed an uncommon E2 allele that contained only 1 cysteine residue. The uncommon allele cosegregated with familial dysbetalipoproteinemia which in these families seemed to behave as a dominant. Smit et al. (1990) showed that these 3 unrelated patients had E2(lys146-to-gln). Eto et al. (Clin. Genet. 36: 183–188, 1989) presented data from Japan indicating that both the E2 allele and the E4 allele are associated with an increased risk of ischemic heart disease as compared with the E3 allele. Boerwinkle and Utermann (Am. J. Hum. Genet. 42: 104–112, 1988) studied the simultaneous effect of apolipoprotein E polymorphism on apolipoprotein E, apolipoprotein B, and cholesterol metabolism. Since both apoB and apoE bind to the LDL receptor and since the different isoforms show different binding affinity, these effects are not unexpected. Subjects with typical dysbetalipoproteinemia are homozygous for an amino acid substitution in apoE at residue 158 (107741.0001). Chappell (Clin. Invest. 84: 1906–1915, 1989) studied the binding properties of lipoproteins in 9 subjects with dysbetalipoproteinemia who were either homozygous or heterozygous for substitutions at atypical sites: at residue 142 in 6, at 145 in 2, and at 146 in 1. In 5 of 19 Australian men, aged 30 to 50, who were referred for coronary angioplasty (26%), van Bockxmeer and Mamotte (Lancet 340: 879–880, 1992) observed homozygosity for E4. This represented a 16-fold increase compared with controls. Payne et al. (Lancet 340: 1350, 1992), O'Malley and Illingworth (Lancet 340: 1350–1351, 1992), and de Knijff et al. (Lancet 340: 1350–1351, 1992) expressed doubts concerning a relationship between E4 and atherosclerosis. Feussner et al. (Am. J. Med. Genet. 65: 149–154, 1996) reported a 20-year-old man with a combination of type III hyperlipoproteinemia and heterozygous familial hypercholesterolemia (FH;143890). Multiple xanthomas were evident on the elbows, interphalangeal joints and interdigital webs of the hands. Lipid-lowering therapy caused significant decrease of cholesterol and triglycerides as well as regression of the xanthomas. Flat xanthomas of the interdigital webs were also described in 3 out of 4 previously reported patients with combination of these disorders of lipoprotein metabolism. Feussner et al. (1996) stated that these xanthomas may indicate compound heterozygosity (actually double heterozygosity) for type III hyperlipoproteinemia and FH.

Saunders et al. (Neurology 43: 1467–1472, 1993) reported an increased frequency of the E4 allele in a small prospective series of possible-probable AD patients presenting to the memory disorders clinic at Duke University, in comparison with spouse controls. Corder et al. (Science 261: 921–923, 1993) found that the APOE*E4 allele is associated with the late-onset familial and sporadic forms of Alzheimer disease. In 42 families with the late-onset form of Alzheimer disease (AD2; 104310), the gene had been mapped to the same region of chromosome 19 as the APOE gene. Corder et al. (1993) found that the risk for AD increased from 20 to 90% and mean age of onset decreased from 84 to 68 years with increasing number of APOE*E4 alleles. Homozygosity for APOE*E4 was virtually sufficient to cause AD by age 80. Lannfelt et al. (Alzheimer Dis. Assoc. Disord. 9: 166–169, 1995) compared allelic frequency of apolipoprotein E4 in 13 dizygotic twin pairs discordant for Alzheimer disease and found the expected increased frequency of the epsilon-4 allele in Alzheimer compared to healthy cotwins. In a well-known American kindred with late-onset Alzheimer disease, descended from a couple who immigrated to the United States from France in the 18th century, Borgaonkar et al. (Lancet 342: 625, 1993) found evidence confirming a dosage effect of the E4 allele of 6 affected individuals; 4 E4/E4 homozygotes had onset in their 60s, whereas 2 E4/E3 heterozygotes had onset at ages 77 and 78, respectively. Apolipoprotein E is found in senile plaques, congophilic angiopathy, and neurofibrillary tangles of Alzheimer disease. Strittmatter et al. (Proc. Nat. Acad. Sci. 90: 1977–1981, 1993) compared the binding of synthetic amyloid beta peptide to purified APOE4 and APOE3, the most common isoforms. Both isoforms in oxidized form bound the amyloid beta peptide; however, binding to APOE4 was observed in minutes, whereas binding to APOE3 required hours. Strittmatter et al. (1993) concluded that binding of amyloid beta peptide by oxidized apoE may determine their sequestration and that isoform-specific differences in apoE binding or oxidation may be involved in the pathogenesis of the lesions of Alzheimer disease. In a study of 91 patients with sporadic Alzheimer disease and 74 controls, Poirier et al. (Lancet 342: 697–699, 1993) found a significant association between E4 and sporadic AD. The association was more pronounced in women. Scott (1993) pointed to the need for caution in the application of knowledge gained through screening of E4 in relation to this very common disorder. In a case-control study of 338 centenarians compared with adults aged 20 to 70 years of age, Schachter et al. (Lancet 342: 696, 1994) found that the E4 allele of apoE, which promotes premature atherosclerosis, was significantly less frequent in centenarians than in controls (p=less than 0.001), while the frequency of the E2 allele, associated previously with types III and IV hyperlipidemia, was significantly increased (p=less than 0.01). Talbot et al. (Lancet 343: 1432–1433, 1994) presented data suggesting that the E2 allele may confer protection against Alzheimer disease and that its effect is not simply the absence of an E4 allele. Corder et al. (Nature Genet. 7: 180–184, 1994) presented data demonstrating a protective effect of the E2 allele, in addition to the dosage effect of the E4 allele in sporadic AD. Although a substantial proportion (65%) of AD is attributable to the presence of E4 alleles, risk of AD is lowest in subjects with the E2/E3 genotype, with an additional 23% of AD attributable to the absence of an E2 allele. The opposite actions of the E2 and E4 alleles were interpreted by Corder et al. (1994) to provide further support for the direct involvement of APOE in the pathogenesis of AD. Sanan et al. (J. Clin. Invest. 94: 860–869, 1994) demonstrated that the E4 isoform binds to the beta amyloid (A-beta) peptide more rapidly than the E3 isoform. Soluble SDS-stable complexes of E3 or E4, formed by coincubation with the A-beta peptide, precipitated after several days of incubation at 37 degrees C., with E4 complexes precipitating more rapidly than E3 complexes.

Hyman et al. (Arch. Neurol. 53: 215, 1996) demonstrated homozygosity for the E4 genotype in an 86-year-old man with no history of neurologic disease and whose autopsy did not reveal any neurofibrillary tangles and only rare mature senile plaques. This suggested to the authors that inheritance of apoE4 does not necessarily result in the development of dementia or Alzheimer disease. Myers et al. (Neurology 46: 673–677, 1996) examined the association of apolipoprotein E4 with Alzheimer disease and other dementias in 1,030 elderly individuals in the Framingham Study cohort. They found an increased risk for Alzheimer disease as well as other dementias in patients who were homozygous or heterozygous for E4. However they pointed out that most apoE4 carriers do not develop dementia and about one-half of Alzheimer disease is not associated with apoE4. Kawamata et al. (J. Neurol. Neurosurg. Psychiat. 57: 1414–1416, 1994) examined the E4 frequency in 40 patients with late-onset sporadic Alzheimer disease, 13 patients with early-onset sporadic Alzheimer disease, 19 patients with vascular dementia, and 49 nondemented control subjects. In the late-onset sporadic Alzheimer group, the allele frequency was 0.25, considerably higher than the frequency in controls, 0.09. In contrast, there was no increased frequency in early-onset sporadic Alzheimer disease or in patients with vascular dementia. Olichney et al. (Neurology 47: 190–196, 1996) found that the apolipoprotein E4 allele is strongly associated with increased neuritic plaques but not neocortical or fibrillary tangles in both Alzheimer disease and the Lewy body variant. Greenberg et al. (Ann. Neurol. 38: 254–259, 1995) found that the presence of apolipoprotein E4 increased the odds ratio for moderate or severe cerebral amyloid angiopathy significantly, even after controlling for the presence of Alzheimer disease. In a postmortem study, Greenberg et al. (Neurology 50: 961–965, 1998) found an association between apolipoprotein E2 and vasculopathy in cerebral amyloid angiopathy. Of 75 brains with complete amyloid replacement of vessel walls, only 23 had accompanying signs of hemorrhage in cracks of the vessel wall. The frequency of apolipoprotein E2 was significantly higher in the group with vasculopathy. The authors suggested that apolipoprotein E2 and E4 might promote hemorrhage through separate mechanisms: E4 by enhancing amyloid deposition and E2 by promoting rupture. O'Donnell et al. (New Eng. J. Med. 342: 240–245, 2000) identified a specific apolipoprotein E genotype as a risk factor for early recurrence of cerebral amyloid angiopathy: carriers of the E2 (107741.0001) or E4 (107741.0016) allele had an increased risk for early recurrence compared to individuals with the E3/E3 (107741.0015) genotype. Kawamata et al. (1994) speculated that the lower magnitude of the raised frequency of E4 in the Japanese group compared to that of North American families may be due to a lower E4 frequency in the normal Japanese population and lower morbidity from Alzheimer disease in Japan. Nalbantoglu et al. (Ann. Neurol. 36: 889–895, 1994) performed apolipoprotein analysis on 113 postmortem cases of sporadic Alzheimer disease and 77 control brains in Montreal. In this population, the odds ratio associating E4 with Alzheimer disease was 15.5 and the population attributable risk was 0.53. Yoshizawa et al. (Ann. Neurol. 36: 656–659, 1994) examined the apolipoprotein genotypes in 83 Japanese patients with Alzheimer disease. They found a significant increase in apoE4 frequency in late-onset sporadic Alzheimer disease and a mild increase of apoE4 frequency in late- and early-onset familial Alzheimer disease. In contrast, they found no association between apoE4 and early-onset sporadic Alzheimer disease. Lucotte et al. (Ann. Neurol. 36: 681–682, 1994) examined the apoE4 frequency in 132 French patients with onset of Alzheimer disease after 60 years of age. They found that homozygosity for the E4 allele was associated with a younger age of disease occurrence than was heterozygosity or absence of the E4 allele. Osuntokun et al. (Ann. Neurol. 38: 463–465, 1995) found no association between E4 and Alzheimer disease in elderly Nigerians, in contrast to the strong association reported in their previous study of African Americans in Indianapolis. Levy-Lahad et al. (Ann. Neurol. 38: 678–680, 1995) found that the epsilon 4 allele did not affect the age of onset in either Alzheimer disease type 4 present in Volga Germans (600753) or Alzheimer disease type 3 (104311). This suggested to them that some forms of early onset familial Alzheimer disease are not influenced by the apolipoprotein E system. Bennett et al. (Am. J. Med. Genet. 60: 1–6, 1995) examined the APOE genotype in family history-positive and family history-negative cases of Alzheimer disease and found a distortion of the APOE allele frequencies similar to those with previous studies. However, they also examined the allele distribution of at-risk sibs and found an excess of the E4 allele which did not differ from that of affected sibs. In these families, they found no evidence for linkage between the APOE4 locus and Alzheimer disease. They concluded that the APOE locus is neither necessary nor sufficient to cause Alzheimer disease and speculated that it may modify the preclinical progression, and therefore the age of onset, in people otherwise predisposed to develop Alzheimer disease. Head injury is an epidemiologic risk factor for Alzheimer disease and deposition of A-beta occurs in approximately one-third of individuals dying after severe headinjury. Nicoll et al. (Nature Med. 1: 135–137, 1995) found that the frequency of APOE4 in individuals with A-beta deposition following head injury (0.52) was higher than in most studies of Alzheimer disease, while in those head-injured individuals without A-beta deposition, the APOE4 frequency (0.16) was similar to controls without Alzheimer disease (P=less than 0.00001). Thus, environmental and genetic risk factors for Alzheimer disease may act additively. In a prospective study of 69 patients with severe blunt trauma to the head, Friedman et al. (Neurology 52: 244–248, 1999) found an odds ratio of 5.69 for more than 7 days of unconsciousness and 13.93 for a suboptimal neurologic outcome at 6 months for individuals with an APOE4 allele compared to those without that allele. In a review of apolipoprotein E and Alzheimer disease, Strittmatter and Roses (Proc. Nat. Acad. Sci. 90: 1977–1981, 1995) pointed out that isoform-specific differences have been identified in the binding of apoE to the microtubule-associated protein tau (157140), which forms the paired helical filament and neurofibrillary tangles, and to amyloid beta peptide (104760), a major component of the neuritic plaque. Identification of apoE in the cytoplasm of human neurons and isoform-specific binding of apoE to the microtubule-associated protein tau and MAP-2 (157130) make it possible that apoE may affect microtubule function in the Alzheimer brain. Blennow et al. (Neuroreport 5: 2534–2536, 1994) demonstrated a significant reduction of CSF apolipoprotein E in Alzheimer disease compared to that of controls. They suggested that the increased reutilization of apolipoprotein E lipid complexes in the brain in Alzheimer disease may explain the low CSF concentration.

The observation that the APOE4 allele is neither necessary nor sufficient for the expression of AD emphasizes the significance of other environmental or genetic factors that, either in conjunction with APOE4 or alone, increase the risk of AD. Kamboh et al. (Nature Genet. 10: 486–488, 1995) noted that among the candidate genes that might affect the risk for Alzheimer disease is alpha-1-antichymotrypsin (AACT; 107280) because, like APOE protein, AACT binds to beta-amyloid peptide with high affinity in the filamentous deposits found in the AD brain. Additionally, it serves as a strong stimulatory factor in the polymerization of beta-amyloid peptide into amyloid filaments. Kamboh et al. (Am. J. Hum. Genet. 58: 574–584, 1995) demonstrated that a common polymorphism in the signal peptide of AACT (107280.0005) confers a significant risk for AD and that the APOE4 gene dosage effect associated with AD risk is significantly modified by the AACT polymorphism. They identified the combination of the AACT 'AA' genotype with the APOE4/4 genotype as a potential susceptibility marker for AD, as its frequency was 1/17 in the AD group compared to 1/313 in the general population controls. It is noteworthy that one form of Alzheimer disease (designated Alzheimer type 3, 104311), like AACT, maps to 14q; however, AACT and AD3 are located at somewhat different sites on 14q. Tang et al. (1996) compared relative risks by APOE genotypes in a collection of cases and controls from 3 ethnic groups in a New York community. The relative risk for Alzheimer disease associated with APOE4 homozygosity was increased in all ethnic groups: African American RR=3.0; Caucasian RR=7.3; and Hispanic RR=2.5 (compared with the RR with APOE3 homozygosity). The risk was also increased for APOE4 heterozygous Caucasians and Hispanics, but not for African Americans. The age distribution of the proportion of Caucasian and Hispanics without AD was consistently lower for APOE4 homozygous and APOE4 heterozygous individuals than for those with other APOE genotypes. In African Americans this relationship was observed only in APOE4 homozygotes. Differences in risk among APOE4 heterozygous African Americans suggested to the authors that other genetic or environmental factors may modify the effect of APOE4 in some populations. In a study of 85 Scottish persons with early onset Alzheimer disease, St Clair et al. (J. Med. Genet. 32: 642–644, 1995) found highly significant enrichment for both homozygous and heterozygous APOE epsilon-4 allele carriers in both familial and sporadic cases with a pattern closely resembling that in late onset AD. As reviewed earlier, the APOE4 allele is associated with sporadic and late-onset familial Alzheimer disease. Gene dose has an effect on risk of developing AD, age of onset, accumulation of senile plaques in the brain, and reduction of choline acetyltransferase (118490) in the hippocampus of AD patients. Poirier et al. (Proc. Nat. Acad. Sci. 92: 12260–12264, 1995) examined the effect of APOE4 allele copy number on pre- and postsynaptic markers of cholinergic activity. APOE4 allele copy number showed an inverse relationship with residual brain CHAT activity and nicotinic receptor binding sites in both the hippocampal formation and the temporal cortex of AD subjects. AD subjects lacking the APOE4 allele showed CHAT activities close to or within the age-matched normal control range. Poirier et al. (1995) then assessed the effect of the APOE4 allele on cholinomimetic drug responsiveness in 40 AD patients who completed a double-blind, 30-week clinical trial of the cholinesterase inhibitor tacrine. Results showed that more than 80% of APOE4-negative AD patients showed marked improvement after 30 weeks, whereas 60% of APOE4 carriers had poor responses. Polyikoski et al. (New Eng. J. Med. 333: 1242–1247, 1995) reported on an autopsy study involving neuropathologic analysis and DNA analysis of frozen blood specimens performed in 92 of 271 persons who were at least 85 years of age, who had been living in Vantaa, Finland, on Apr. 1, 1991, and who had died between that time and the end of 1993. All subjects had been tested for dementia. Apolipoprotein E genotyping was done with a solid-phase minisequencing technique. The percentage of cortex occupied by methenamine silver-stained plaques was used as an estimate of the extent of beta-amyloid protein deposition. They found that the APOE4 allele was significantly associated with Alzheimer disease. Even in elderly subjects without dementia, the apolipoprotein E4 genotype was related to the degree of deposition of beta-amyloid protein in the cerebral cortex. Reiman et al. (New Eng. J. Med. 334: 752–758, 1996) found that in late middle age, cognitively normal subjects who were homozygous for the APOE4 allele had reduced glucose metabolism in the same regions of the brain as in patients with probable Alzheimer disease. These findings provided preclinical evidence that the presence of the APOE4 allele is a risk factor for Alzheimer disease. Positron-emission tomography (PET) was used in these studies; Reiman et al. (1996) suggested that PET may offer a relatively rapid way of testing treatments to prevent Alzheimer disease in the future. In late-onset familial AD, women have a significantly higher risk of developing the disease than do men. Studying 58 late-onset familial AD kindreds, Payami et al. (Am. J. Hum. Genet. 58: 803–811, 1996) detected a significant gender difference for the APOE4 heterozygous genotype. In women, APOE4 heterozygotes had higher risk than those without APOE4; there was no significant difference between APOE4 heterozygotes and APOE4 homozygotes. In men, APOE4 heterozygotes had lower risk than APOE4 homozygotes; there was no significant difference between APOE4 heterozygotes and those without APOE4. A direct comparison of APOE4 heterozygous men and women revealed a significant 2-fold increased risk in women. These results were corroborated in studies of 15 autopsy-confirmed AD kindreds from the National Cell Repository at Indiana University Alzheimer Disease Center. Mahley (Science 240: 622–630, 1988) provided a review documenting the expanding role of apoE as a cholesterol transport protein in cell biology. The pronounced production and accumulation of apoE in response to peripheral nerve injury and during the regenerative process indicates, for example, that apoE plays a prominent role in the redistribution of cholesterol to the neurites for membrane biosynthesis during axon elongation and to the Schwann cells for myelin formation. Poirier (Trends Neurol. Sci. 17: 525–530, 1994) reviewed the coordinated expression of apoE and its receptor, the apoE/apoB LDL receptor (143890), in the regulation of transport of cholesterol and phospholipids during the early and intermediate phases of reinnervation, both in the peripheral and in the central nervous system. He proposed that the linkage of the E4 allele to Alzheimer disease (104300) may represent dysfunction of the lipid transport system associated with compensatory sprouting and synaptic remodeling central to the Alzheimer disease process. Tomimoto et al. (Acta Neuropath. 90: 608–614, 1995) found only 3 cases with focal accumulation of apolipoprotein E in dystrophic axons and accompanying macrophages in 9 cases of cerebral vascular disease and 4 control subjects. The results suggested to the authors that apolipoprotein E may have a role in recycling cholesterol in other membrane components in the brain, but that this phenomenon is restricted to the periphery of infarctions and may be less prominent than in the peripheral nervous system. Egensperger et al. (Biochem. Biophys. Res. Commun. 224: 484–486, 1996) determined the apoE allele frequencies in 35 subjects with neuropathologically confirmed Lewy body parkinsonism with and without concomitant Alzheimer lesions, 27 patients with AD, and 54 controls. They concluded that the apoE4 allele does not function as a risk factor which influences the development of AD lesions in PD. In aggregate, the association studies on apoE in Alzheimer disease suggest epsilon-4 accelerates the neurodegenerative process in Alzheimer disease. However, in 3 independent studies, Kurz et al. (Neurology 47: 440–443, 1996), Growdon et al. (Neurology 47: 444–448, 1996), and Asada et al. (Neurology 47: 603 only 1996) found no differences in the clinical rate of decline of newly diagnosed Alzheimer disease patients with or without the epsilon-4 allele. Bickeboller et al. (Am. J. Hum. Genet. 60: 439–446, 1997) confirmed the increased risk for AD associated with the APOE4 allele in 417 patients compared with 1,030 control subjects. When compared to the APOE3 allele, the authors demonstrated an increased risk associated with the APOE4 allele (odds ratio=2.7) and a protective effect of the APOE2 allele (odds ratio=0.5). An effect of E4 allele dosage on susceptibility was confirmed: the odds ratio of E4/E4 versus E3/E3=11.2; odds ratio of E3/E4 versus E3/E3=2.2. In E3/E4 individuals, sex-specific lifetime risk estimates by age 85 years (i.e., sex-specific penetrances by age 85 years) were 0.14 for men and 0.17 for women. Houlden et al. (Am. J. Med. Genet. 81: 117–121, 1998) found that the APOE genotype is only a risk factor for early-onset AD families with no lesion detectable in the presenilin or APP gene. Meyer et al. (Nature Genet. 19: 321–322, 1998) presented data on an elderly population which suggested that apoE genotype influences the age-specific risk of Alzheimer disease but that, regardless of apoE genotype, more than half of the population will not develop AD by age 100. ApoE genotype did not appear to influence whether subjects will develop AD, but the study did confirm that the apoE4 alleles influence when susceptible individuals will develop AD. The findings could be explained by a gene or genes independent of apoE that condition vulnerability. Wiebusch et al. (Hum. Genet. 104: 158–163, 1999) conducted a case-control study of 135 pathologically confirmed AD cases and 70 non-AD controls (age of death greater than or equal to 60 years) in whom they genotyped for APOE epsilon-4 and BCHE-K (177400.0005). The allelic frequency of BCHE-K was 0.13 in controls and 0.23 in cases, giving a carrier odds ratio of 2.1 (95% confidence interval (CI) 1.1–4.1) for BCHE-K in confirmed AD. In an older subsample of 27 controls and 89 AD cases with ages of death greater than or equal to 75 years, the carrier odds ratio increased to 4.5 (95% CI 1.4–15) for BCHE-K. The BCHE-K association with AD became even more prominent in carriers of APOE epsilon-4. Only 3 of 19 controls compared with 39 of 81 cases carried both, giving an odds ratio of 5.0 (95% CI 1.3–19) for BCHE-K carriers within APOE epsilon-4 carriers. The authors concluded that the BCHE-K polymorphism is a susceptibility factor for AD and enhances the AD risk from APOE epsilon-4 in an age-dependent manner.

Saunders et al. (Lancet 342: 710–711, 1993) found no association of E4 with other amyloid-forming diseases, i.e., Creutzfeldt-Jakob disease (CJD; 123400), familial amyloidotic polyneuropathy, and Down syndrome (190685). On the other hand, Amouyel et al. (Lancet 344: 1315–1318, 1994) concluded that E4 is a major susceptibility factor for CJD. They found a relative risk of CJD between subjects with at least one E4 allele and subjects with none to range between 1.8 and 4.2, depending on the control group used. A variation in disease duration was also noted, depending on apoE genotype, with an increase in duration of illness in E2 allele carriers. Frisoni et al. (Stroke 25: 1703, 1994) assessed the apoE allele frequency in 51 elderly control subjects, 23 subjects with vascular dementia, and 93 patients with Alzheimer disease. There was increased frequency of the E4 allele both in Alzheimer disease and in vascular dementia with respect to both elderly and young control subjects. There was no difference in the proportion of E2, E3, and E4 frequency in Alzheimer disease and vascular dementia patients. Slooter et al. (Lancet 348: 334 only, 1996) compared E4 allele frequency between 185 patients with Alzheimer disease and those with other types of dementia. The authors found little predictive value in distinguishing Alzheimer patients from those with other forms of dementia using APOE genotyping. In contrast, Mahieux et al. (Stroke 25: 1703–1704, 1994) found an increase of E4 in Alzheimer disease, but not in vascular dementia. They speculated that the difference between their results and those of Frisoni et al. (1994) may be attributable to the small size of the groups or to the different mean ages of the populations that they studied. McCarron et al. (Neurology 53: 1308–1311, 1999) performed a metaanalysis that demonstrated a significantly higher frequency of E4 carriers in individuals with ischemic cerebrovascular disease than in control subjects (odds ratio, 1.73). Myers et al. (1996) examined the association of apolipoprotein E4 with Alzheimer disease and other dementias in 1,030 elderly individuals in the Framingham Study cohort. They found an increased risk for Alzheimer disease as well as other dementias in patients who were homozygous or heterozygous for E4. However they pointed out that most apoE4 carriers do not develop dementia and about one-half of Alzheimer disease is not associated with apoE4. Blesa et al. (Ann. Neurol. 39: 548–551, 1996) found an apoE epsilon-4 frequency of 0.315 in patients with age-related memory decline without dementia, similar to the 0.293 allele frequency found in an Alzheimer disease group. This contrasted to the frequency of 0.057 found in their control group. Payami et al. (Am. J. Hum. Genet. 60: 948–956, 1997) reported the results of a prospective case-control study that enlisted 114 Caucasian subjects who were physically healthy and cognitively intact at age 75 years and who were followed, for an average of 4 years, with neurologic, psychometric, and neuroimaging examinations. Excellent health at entry did not protect against cognitive decline. Incidence of cognitive decline rose sharply with age. E4 and a family history of dementia (independent of E4) were associated with an earlier age at onset of dementia. Subjects who had E4 or a family history of dementia had a 9-fold-higher age-specific risk for dementia than did those who had neither. From these observations, Payami et al. (1997) suggested that the rate of cognitive decline increases with age and that APOE and other familial/genetic factors influence the onset age throughout life. In a study of 79 patients with Parkinson disease, 22 of whom were demented, Marder et al. (Neurology 44: 1330–1331, 1994) found that the E4 allele frequency was 0.13 in patients without dementia and 0.068 in those with dementia as opposed to a control value of 0.102. The authors concluded that the biologic basis for dementia in Parkinson disease differs from that of Alzheimer disease. Tabaton et al. (Neurology 45: 1764–1765, 1995) found that, although apolipoprotein E immunoreactivity was found to be associated with neurofibrillary tangles in an autopsy study of 12 patients with progressive supranuclear palsy (601104), the apolipoprotein E allele frequency was similar to that of age-matched controls. Farrer et al. (Exp. Neurol. 136: 162–170, 1995) demonstrated that the number of epsilon-4 alleles was inversely related to the age at onset of Pick disease (172700). Their results suggested that epsilon-4 may be a susceptibility factor for dementia and not specifically for AD. Mui et al. (Ann. Neurol. 38: 460–463, 1995) found no association between apolipoprotein E4 and the incidence or the age of onset of sporadic of autosomal dominant amyotrophic lateral sclerosis (105400). Garlepp et al. (Ann. Neurol. 38: 957–959, 1995) found an increased frequency of the epsilon 4 allele in patients with inclusion body myositis (147421) compared with that in patients with other inflammatory muscle diseases or that in the general population. In a study of apoE genotypes in schizophrenic patients coming to autopsy, Harrington et al. (Neurosci. Lett. 202: 101–104, 1995) found that schizophrenia is associated with an increased E4 allele frequency. The E4 allele frequency in schizophrenia was indistinguishable from that found in either Alzheimer disease or Lewy body dementia (127750). From the age range at autopsy (from 19 to 95 years), they determined that the epsilon-4 frequency was not associated with increased age. Betard et al. (Neuroreport 5: 1893–1896, 1994) analyzed allele frequencies of apoE in 166 autopsied French-Canadian patients with dementia. The E4 frequency was highest in Lewy body dementia (0.472); presenile Alzheimer disease (0.405); senile Alzheimer disease (0.364); and Alzheimer disease with cerebrovascular disease (0.513). In contrast, the E4 allele frequency was 0.079 in autopsied cases of individuals with vascular dementia but no changes of Alzheimer disease. Subjects with vascular dementia demonstrated an increased relative E2 allele frequency of 0.211 compared to 0.144 in elderly controls. In contradistinction to the findings of Betard et al. (1994), Lippa et al. (Neurology 45: 97–103, 1995) found much lower frequency of E4, 0.22, when they were careful to exclude Lewy body patients that had concurrent Alzheimer disease by the Cerat criterion. They did, however, find that a neuritic degeneration in CA2-3 was slightly greater in those Lewy body disease patients with the apoE4 allele than those with the E3/3 genotype. Hyman et al. (Proc. Nat. Acad. Sci. 92: 3586–3590, 1995) found that senile plaques in the Alzheimer disease of Down syndrome were abnormally large, whereas those of APOE4-related Alzheimer disease were unusually numerous. The findings suggested that the pathology in Down syndrome is due to increased amyloid production and deposition, whereas that in APOE4, disease is related to an increased probability of senile plaque initiation. Royston et al. (Neuroreport 5: 2583–2585, 1994) assessed the apoE genotype in elderly Down syndrome patients and found that the epsilon-2 variant was associated both with increased longevity and a significantly decreased frequency of Alzheimer-type dementia. They noted that none of their elderly Down patients was homozygous for the epsilon-4 allele. In a case-control study of apoE genotypes in Alzheimer disease associated with Down syndrome, van Gool et al. (Ann. Neurol. 38: 225–230, 1995) showed that the frequencies of apoE type 2, 3, or 4 were not significantly different in Down syndrome cases with Alzheimer disease compared with aged-matched Down syndrome controls. The apoE 4 frequency in Down syndrome cases with Alzheimer disease was significantly lower than in any other Alzheimer disease populations studied thus far, suggesting that apoE4 does not significantly affect the pathogenesis of Alzheimer disease in Down syndrome patients. Kehoe et al. (J. Med. Genet. 36: 108–111, 1999) showed that the APOE epsilon-2/epsilon-3 genotype is associated with significantly earlier age of onset of Huntington disease (143100) in males than in females. This sex difference was not apparent for any other APOE genotypes.

Olaisen et al. (Hum. Genet. 62: 233–236, 1982) found linkage of C3 (120700) and apoE with a lod score of 3.00 in males at a recombination fraction of 13%. Since the C3 locus is on chromosome 19, apoE can be assigned to that chromosome also. The authors stated that preliminary evidence suggested that the apoE locus is close to the secretor locus (182100). Berg et al. (Cytogenet. Cell Genet. 37: 417, 1984) studied apoE-C3 linkage with a C3 restriction fragment length polymorphism. Low positive lod scores were found when segregation was from a male (highest score at recombination fraction 0.17). Using DNA probes, Das et al. (J. Biol. Chem. 260: 6240–6247, 1985) mapped the apoE gene to chromosome 19 by Southern blot analysis of DNA from human-rodent somatic cell hybrids. Humphries et al. (Clin. Genet. 26: 389–396, 1984) used a common TaqI RFLP near the APOC2 gene to demonstrate close linkage to APOE in 7 families segregating for APOE protein variants. No recombination was observed in 20 opportunities. Apparent linkage disequilibrium was observed. On the other hand, Houlston et al. (Hum. Genet. 83: 364–368, 1989), using a robust PCR-based method for apoE genotyping, found no strong linkage disequilibrium between the APOE and APOC2 loci. Gedde-Dahl et al. (Hum. Genet. 67: 178–182, 1984) found linkage between Se and APOE with a peak lod score of 3.3 at recombination fraction of 0.08 in males and 1.36 at 0.22 in females, and linkage between APOE and Lu with a lod score 4.52 at zero recombination (sexes combined). The C3-APOE linkage gave lod score 4.00 at theta 0.18 in males and 0.04 at theta 0.45 in females. Triply heterozygous families confirmed that APOE is on the Se side and on the Lu side of C3. Lusis et al. (Proc. Nat. Acad. Sci. 83: 3929–3933, 1986) used a reciprocal whole arm translocation between the long arm of 19 and the short arm of chromosome 1 to map APOC1, APOC2, APOE and GPI to the long arm and LDLR, C3 and PEPD to the short arm. Furthermore, they isolated a single lambda phage that carried both APOC1 and APOE separated by about 6 kb of genomic DNA. Since family studies indicate close linkage of APOE and APOC2, the 3 must be in a cluster on 19q.

Because apolipoprotein E is a ligand for receptors that clear remnants of chylomicrons and very low density lipoproteins, lack of apoE would be expected to cause accumulation in plasma of cholesterol-rich remnants whose prolonged circulation should be atherogenic. Zhang et al. (Science 258: 468–471, 1992) demonstrated that this was indeed the case:

apoE-deficient mice generated by gene targeting (Piedrahita et al., Proc. Nat. Acad. Sci. 89:4471–4475, 1992) had 5 times normal plasma cholesterol and developed foam cell-rich depositions in their proximal aortas by age 3 months. These spontaneous lesions progressed and caused severe occlusion of the coronary artery ostium by 8 months. Plump et al. (Cell 71:343–353, 1992) independently found the same in apoE-deficient mice created by homologous recombination in ES cells. The findings in the mouse model are comparable to those in 3 human kindreds with inherited apoE deficiency (Ghiselli et al., Science 214: 1239–1241, 1981; Mabuchi et al., Metabolism 38: 115–119, 1989; Kurosaka et al., Atherosclerosis 88: 15–20, 1991). Commenting on the articles of Plump et al. (1992) and Zhang et al. (1992), Brown and Goldstein (Cell 71: 187–188, 1992) pointed out that molecular genetics has given us the opportunity to satisfy Koch's postulates for multifactorial metabolic diseases. Further use of the apoE gene-targeted mice was made by Linton et al. (Science 267: 1034–1037, 1995), who showed that the severe hyperlipidemia and atherosclerosis in these mice could be prevented by bone marrow transplantation. Although the majority of apoE in plasma is of hepatic origin, the protein is synthesized by a variety of cell types, including macrophages. Because macrophages derive from hematopoietic cells, bone marrow transplantation seemed a possible therapeutic approach. ApoE-deficient mice given transplants of normal bone marrow showed apoE in the serum and a normalization of serum cholesterol levels. Furthermore, they showed virtually complete protection from diet-induced atherosclerosis. To unravel the metabolic relationship between apoE and apoC1 in vivo, van Ree et al. (Hum. Molec. Genet. 4: 1403–1409, 1995) generated mice deficient in both apolipoproteins. This enabled subsequent production of transgenic mice with variable ratios of normal and mutant apoE and apoC1 on a null background. They found that double inactivation of the ApoE and ApoC1 (107710) loci in mice, as well as single inactivations at either one of these loci, also affected the levels of RNA expression of other members of the Apoe-c1-c2 cluster. Homozygous Apoe-c1 knockout mice were hypercholesterolemic and, with serum cholesterol levels more than 4 times the control value, resembled mice solely deficient in apoE.

Kashyap et al. (J. Clin. Invest. 96: 1612–1620, 1995) noted that apolipoprotein E-deficient mice, generated using homologous recombination for targeted gene disruption in embryonic stem cells, developed marked hyperlipidemia as well as atherosclerosis. Kashyap et al. (1995) found that intravenous infusion of a recombinant adenovirus containing the human APOE gene resulted in normalization of the lipid and lipoprotein profile with markedly decreased total cholesterol, VLDL, IDL, and LDL, as well as increased HDL. A marked reduction in the extent of aortic atherosclerosis was observed after one month. Plump et al. (1992) and Zhang et al. (1992) created apoE-deficient mice by gene targeting in embryonic stem cells. These mice displayed severe hypercholesterolemia even on a low-fat, low cholesterol diet. A key regulator of cholesterol-rich lipoprotein metabolism, apoE, is synthesized by numerous extrahepatic tissues. It is synthesized, for example, in macrophages. To assess the contribution of macrophage-derived apoE to hepatic clearance of serum cholesterol, Boisvert et al. (J. Clin. Invest. 96: 1118–1124, 1995) performed bone marrow transplantation on hypercholesterolemic apoE-deficient 'knockout' mice. Serum cholesterol levels dropped dramatically in the bone marrow-treated mice largely due to a reduction in VLDL cholesterol. The extent of atherosclerosis in the treated mice was also greatly reduced. Wildtype apoE mRNA was detected in the liver, spleen, and brain of the treated mice indicating that gene transfer was successfully achieved through bone marrow transplantation. Masliah et al. (Exp. Neurol. 136: 107–122, 1995) observed an age-dependent loss of synaptophysin-immunoreactive nerve terminals and microtubule-associated protein 2-immunoreactive dendrites in the neocortex and hippocampus of apoE-deficient (knockout) mice. They suggested that apoE may play a role in maintaining the stability of the synapto-dendritic apparatus. Sullivan et al. (J. Biol. Chem. 272: 17972–17980, 1997) found that when the mouse apolipoprotein E gene was replaced by the human APOE3 gene in transgenic mice, diet-induced hypercholesterolemia and atherosclerosis were considerably enhanced. To assess the effects of human APOE isoforms on deposition of amyloid-beta protein in vivo, Holtzman et al. (J. Clin. Invest. 103: R15-R21, 1999) bred apoE3 and apoE4 hemizygous (+/−) transgenic mice expressing APOE by astrocytes to mice homozygous (+/+) for a mutant amyloid precursor protein, V717F (104760.0003), transgene that developed age-dependent Alzheimer disease neuropathology. All mice had an apoE null (−/−) background. By 9 months of age, the mice heterozygous for the human V717F mutant had developed deposition of amyloid-beta protein, and the quantity of amyloid-beta deposits was significantly less than that seen in heterozygous mice expressing mouse apoE. In contrast to effects of mouse apoE, similar levels of human apoE3 and apoE4 markedly suppressed early amyloid-beta deposition at 9 months of age in the V717F heterozygous transgenic mice, even when compared with mice lacking apoE. These findings suggested that human APOE isoforms decrease amyloid-beta aggregation or increase amyloid-beta clearance relative to an environment in which mouse apoE or no apoE is present. Raber et al. (Nature 404: 352–354, 2000) tested the spatial memory of transgenic mice carrying human forms of amyloid precursor protein and either apoE3 or apoE4 and found that it was impaired in mice with apoE4 but not in those with apoE3, even though the levels of beta-amyloid in their brains were comparable. As no plaques were detectable in APP and APP/apoE mice at 6 months of age, Raber et al. (2000) concluded that the differential effects of apoE isoforms on human amyloid precursor protein/ amyloid beta-induced cognitive impairments are independent of plaque formation. Learning deficits were more significant in female than in male mice. These sex-dependent differences may relate to the increased susceptibility of women to APOE4-associated cognitive deficits.

Corbo and Scacchi (Ann. Hum. Genet. 63: 301–310, 1999) analyzed the APOE allele distribution in the world. They pointed out that the APOE3 allele is the most frequent in all human groups, especially in populations with a long-established agricultural economy such as those of the Mediterranean basin, where the allele frequency is 0.849–0.898. The frequency of the APOE4 allele, the ancestral allele, remains higher in populations such as Pygmies (0.407) and Khoi San (0.370), aborigines of Malaysia (0.240) and Australia (0.260), Papuans (0.368), some Native Americans (0.280), and Lapps (0.310) where an economy of foraging still exists, or food supply is (or was until shortly before the time of the report) scarce and sporadically available. The APOE2 frequency fluctuates with no apparent trend (0.145–0.02) and is absent in Native Americans. Corbo and Scacchi (1999) suggested that the APOE4 allele, based on some functional properties; may be a 'thrifty' allele. The exposure of APOE4 to the environmental conditions at the time of the report (Western diet, longer lifespans) may have rendered it a susceptibility allele for coronary artery disease and Alzheimer disease. The absence of the association of APOE4 with either disorder in sub-Saharan Africans, and the presence of the association in African Americans, seems to confirm this hypothesis.

In a large multicenter case control study of myocardial infarction using 567 cases and 678 controls, Lambert et al. (Hum. Molec. Genet. 9: 57–61, 2000) identified an increased risk of myocardial infarction among patients carrying the −219T allele, a promoter polymorphism. The odds ratio was 1.29, with a 95% confidence interval of 1.09 to 1.52 and a P value of less than 0.003. The effect of the allele was independent of the presence of other promoter polymorphisms or mutations including the APOE epsilon-2/epsilon-3/epsilon-4 polymorphism. Moreover, the −219T allele greatly decreased the APOE plasma concentrations in a dose-dependent manner (P less than 0.008). Lambert et al. (2000) concluded that the −219 G-to-T polymorphism of the APOE regulatory region is a genetic susceptibility risk factor for myocardial infarction and constitutes another common risk factor for both neurodegenerative and cardiovascular diseases. To determine the effect of APOE on deposition of amyloid-beta and Alzheimer disease pathology, Holtzman et al. (Proc. Nat. Acad. Sci. 97: 2892–2897, 2000) compared APP(V717F) transgenic mice expressing mouse, human, or no APOE. A severe, plaque-associated neuritic dystrophy developed in the transgenic mice expressing mouse or human APOE. Although significant levels of amyloid-beta deposition also occurred in APP(V717F) transgenics that completely lacked APOE, neuritic degeneration was virtually absent. Expression of APOE3 and APOE4 in APP(V717F) transgenics who had knockout of APOE resulted in fibrillar amyloid-beta deposits and neuritic plaques by 15 months of age, and more than 10-fold more fibrillar deposits were observed in APOE4-expressing APP (V717F) transgenic mice. The data demonstrated a critical and isoform-specific role for APOE in neuritic plaque formation, a pathologic hallmark of Alzheimer disease.

NOV19

A disclosed NOV19 nucleic acid of 3839 nucleotides (also referred to as CG55906-01) (SEQ ID NO:57) encoding a novel S3-12-like protein is shown in Table 19A. An open reading frame was identified beginning with an ATG initiation codon at nucleotides 131–133 and ending with a TAG codon at nucleotides 3806–3808. Putative untranslated regions upstream from the initiation codon and downstream from the termination codon are underlined and the start and stop codons are in bold in Table 19A.

TABLE 19A

NOV19 nucleotide sequence

<u>GTGAGGCCAGGCCTGCAGGTGGGTGTCGGGCTGCTCAGGCTTTCAGTGGGGAGTGGGTGT</u>  (SEQ ID NO:57)

<u>GGGATGGGAGGCTAGGGAACCCCCATTCACGCACCTTCTCTGCCCCCTTCCAGCTTCTCA</u>

<u>CGTTCTCAC</u>ATGTCTGCTCCAGACGAAGGGAGACGGGATCCCCCCAAACCGAAGGGCAA

GCCCCCCGCCCCCATGCAGACCCTGGGCAGCTTCTTTGGGTCCCTGCCTGGCTTCAGCTC

TGCCCGGAACCTGGTGGCCAACGCACATAGCTCGGTCGGGGCCAAAGACCTGGTGTGTTC

CAAGATGTCCAGGGCCAAGGATGCCGTGTCCTCCGGGGTGGCCAGCGTGGTGGACGTGGC

TAAGGGAGTGGTCCAGGGAGGCCTGGACACCACTCGGTCTGCACTTACGGGCACCAAGGA

GGTGGTGTCCAGCGGGGTCACAGGGGCCATGGACATGGCTAAGGGGGCCGTCCAAGGGGG

TCTGGACACCTCGAAGGCTGTCCTCACCGGCACCAAGGACACGGTGTCCACTGGGCTCAC

GGGGGCAGTGAATGTGGCCAAAGGGACCGTACAGGCCGGTGTGGACACCACCAAGACTGT

GCTGACCGGCACCAAAGACACAGTGACTACTGGGGTCATGGGGGCAGTGAACTTGGCCAA

AGGGACTGTCCAGACTGGCGTGGAAACCTCCAAGGCTGTGCTGACCGGCACCAAAGATGC

TGTGTCCACTGGGCTCACAGGGGCAGTGAATGTGGCCAGAGGAAGCATTCAGACCGGTGT

GGACACCAGTAAGACTGTCCTAACAGGTACCAAGGACACCGTCTGTAGTGGGGTGACTGG

TGCCATGAATGTGGCCAAAGGAACCATCCAGACCGGCGTGGACACCAGTAAGACTGTCCT

AACAGGTACCAAGGACACCGTCTGTAGTGGGGTGACTGGTGCCATGAATGTGGCCAAAGG

AACCATCCAGACCGGCGTGGACACCAGTAAGACTGTCCTAACAGGTACCAAGGACACCGT

CTGTAGTGGGGTGACTGGTGCCATGAATGTGGCCAAAGGAACCATCCAGACCGGCGTGGA

CACCACCAAGACTGTCCTAACTGGCACCAAGAACACTGTCTGCAGTGGGGTGACCGGTGC

CGTGAACTTGGCCAAAGAGGCCATCCAGGGGGGCCTGGATACCACCAAGTCTATGGTCAT

GGGTACGAAAGACACGATGTCCACTGGGCTCACAGGGGCAGCGAATGTGGCCAAGGGGGC

CATGCAAACTGGGCTGAACACAACCCAAAATATCGCAACAGGTACAAAGGACACCGTCTG

CAGTGGGGTGACTGGTGCCATGAATTTGGCCAGAGGAACCATCCAGACAGGCGTGGACAC

TABLE 19A-continued

NOV19 nucleotide sequence

CACCAAGATCGTTCTAACTGGTACCAAGGACACTGTCTGCAGTGGGGTCACCGGTGCTGC
GAATGTGGCCAAAGGGGCCGTCCAGGGCGGCCTGGACACTACAAAGTCTGTCCTGACTGG
CACTAAAGATGCTGTGTCCACTGGGCTCACAGGGGCTGTGAACGTGGCCAAAGGGACCGT
CCAGACCGGCGTAGACACCACCAAGACTGTCCTAACCGGCACCAAGGACACCGTCTGCAG
TGGGGTGACCAGTGCTGTGAACGTGGCCAAAGGGGCCGTCCAGGGGGCCTGGACACCAC
CAAGTCTGTGGTCATAGGTACAAAAGACACGATGTCCACTGGGCTCACGGGGGCAGCGAA
TGTGGCCAAGGGGGCTGTCCAGACAGGTGTAGACACAGCCAAGACCGTGCTGACCGGCAC
CAAGGACACAGTGACTACTGGGCTCGTGGGGGCAGTGAATGTCGCCAAAGGGACCGTCCA
GACAGGCATGGACACCACCAAAACTGTCCTAACCGGTACCAAGGACACCATCTACAGTGG
GGTCACCAGTGCCGTGAACGTGGCCAAGGGGCTGTGCAAACTGGGCTGAAAACGACCCA
AAATATCGCGACAGGTACAAAGAACACCTTTGGCAGTGGGGTGACCAGTGCTGTGAATGT
GGCCAAAGGGGCTGCCCAGACAGGTGTAGACACGGCCAAGACCGTGCTGACCGGCACCAA
GGACACAGTCACTACTGGGCTCATGGGGGCAGTGAATGTCGCCAAAGGGACTGTCCAGAC
CAGTGTGGACACCACCAAGACTGTCCTAACTGGTACCAAGGACACCGTCTGCAGTGGGGT
GACCGGTGCTGCGAATGTGGCCAAAGGGGCCATCCAAGGGGGCCTGGACACTACAAAGTC
TGTCCTGACTGGCACTAAAGATGCTGTGTCCACTGGGCTCACAGGGGCTGTGAAGTTGGC
CAAAGGGACTGTCCAGACCGGCATGGACACCACCAAGACTGTGTTAACTGGTACCAAGGA
TGCTGTGTGCAGTGGGGTGACCGGTGCTGCGAATGTGGCCAAGGGGCCGTCCAGATGGG
TGTAGACACGGCCAAGACCGTGCTGACCGGTACCAAGGACACTGTCTGCAGTGGGGTCAC
CGGTGCTGCGAACGTGGCCAAGGGTGCTGTGCAAACTGGGCTGAAAACGACCCAAAATAT
CGCAACAGGTACAAAGAACACCCTTGGCAGTGGGGTGACCGGTGCTGCGAAAGTGGCCAA
AGGGGCCGTCCAGGGGGGCCTGGACACTACAAAGTCTGTCCTGACTGGCACTAAAGATGC
CGTGTCCACTGGGCTCACAGGGGCTGTGAACTTGGCCAAAGGGACTGTCCAGACCGGCGT
GGACACCAGCAAGACTGTCCTGACCGGTACCAAGGACACCGTCTGCAGTGGAGTCACTGG
TGCCGTAAATGTGGCCAAAGGGACCGTCCAGACAGGTGTGGACACAGCCAAGACGGTGCT
GAGTGGCGCTAAGGATGCAGTGACTACTGGAGTCACGGGGGCAGTGAATGTGGCCAAAGG
AACCGTGCAGACCGGCGTGGACGCCTCCAAGGCTGTGCTTATGGGTACCAAGGACACTGT
CTTCAGTGGGGTTACCGGTGCCATGAGCATGGCCAAAGGGGCCGTCCAGGGGGGCCTGGA
CACCACCAAGACAGTGCTGACCGGAACCAAAGACGCAGTGTCCGCTGGGCTCATGGGGTC
AGGGAACGTGGCGACAGGGGCCACCCACACTGGCCTCAGCACCTTCCAGAACTGGTTACC
TAGTACCCCCGCCACCTCCTGGGGTGGACTCACCAGTTCCAGGACCACAGCTCAGCTGGC
TGCCTCCCAGCCTGGGCCAAAGGTGCTGTCGGCGGAACAGGGGAGCTACTTCGTTCGTTT
AGGTGACCTGGGTCCCAGCTTCCGCCAGCGGGCATTTGAACACGCGGTGAGCCACCTGCA
GCACGGCCAGTTCCAAGCCAGGGACACTCTGGCCCAGCTCCAGGACTGCTTCAGGCTGAT
TGAAAAGGCCCAGCAGGCTCCAGAAGGGCAGCCACGTCTGGACCAGGGCTCAGGTGCCAG
TGCGGAGGACGCTGCTGTCCAGGAGAGGGTCTGCGGCCTTCTCCGGCAGCTGCACACGGC
CTACAGTGGCCTGGTCTCCAGCCTCCAGGGCCTGCCCGCCGAGCTCCAGCAGCCAGTGGG
GCGGGCGCGGCACAGCCTCTGTGAGCTCTATGGCATCGTGGCCTCAGCTGGCTCTGTAGA
GGAGCTGCCCGCAGAGCGGCTGGTGCAGAGCCGCGAGGGTGTGCACCAGGCTTGGCAGGG

TABLE 19A-continued

NOV19 nucleotide sequence

GTTAGAGCAGCTGCTGGAGGGCCTACAGCACAATCCCCCGCTCAGCTGGCTGGTAGGGCC

CTTCGCCTTGCCCGCTGGCGGGCAGTAGCTGTAGGAGCCTGCAGGCCCGGCGCGGGGTC

The S3-12-like NOV19 disclosed in this invention maps to chromosome 19.

In a search of sequence databases, it was found, for example, that the nucleic acid sequence of this invention has 2100 of 3062 bases (68%) identical to a gb:GENBANK-ID:AF064748|acc:AF064748.1 mRNA from *Mus musculus* (*Mus musculus* S3-12 mRNA, complete cds).

A disclosed NOV19 polypeptide (SEQ ID NO:58) encoded by SEQ ID NO:57 has 1225 amino acid residues and is presented in Table 19B using the one-letter code. Although SignalP, Psort and/or hydropathy suggest that the S3-12-like NOV19 protein may be localized at the cytoplasm, with a certainty of 0.4500, the protein predicted here is similar to the S3-12 family, some members of which are membrane localized. Therefore it is likely that this novel S3-12-like protein is available at the same sub-cellular localization and hence accessible to a diagnostic probe and for various therapeutic applications. In an alternative embodiment NOV19 is likely to be localized to the microbody (peroxisome) with a certainty of 0.3000, or to the lysosome (lumen) with a certainty of 0.2966, or to the mitochondrial matrix space with a certainty of 0.1000.

TABLE 19B

NOV19 protein sequence

MSAPDEGRRDPPKPKGKPPAPMQTLGSFFGSLPGFSSARNLVANAHSSVGAKDLVCSKMS     (SEQ ID NO:58)

RAKDAVSSGVASVVDVAKGVVQGGLDTTRSALTGTKEVVSSGVTGAMDMAKGAVQGGLDT

SKAVLTGTKDTVSTGLTGAVNVAKGTVQAGVDTTKTVLTGTKDTVTTGVMGAVNLAKGTV

QTGVETSKAVLTGTKDAVSTGLTGAVNVARGSIQTGVDTSKTVLTGTKDTVCSGVTGAMN

VAKGTIQTGVDTSKTVLTGTKDTVCSGVTGAMNVAKGTIQTGVDTSKTVLTGTKDTVCSG

VTGAMNVAKGTIQTGVDTTKTVLTGTKNTVCSGVTGAVNLAKEAIQGGLDTTKSMVMGTK

DTMSTGLTGAANVAKGAMQTGLNTTQNIATGTKDTVCSGVTGAMNLARGTIQTGVDTTKI

VLTGTKDTVCSGVTGAANVAKGAVQGGLDTTKSVLTGTKDAVSTGLTGAVNVAKGTVQTG

VDTTKTVLTGTKDTVCSGVTSAVNVAKGAVQGGLDTTKSVVIGTKDTMSTGLTGAANVAK

GAVQTGVDTAKTVLTGTKDTVTTGLVGAVNVAKGTVQTGMDTTKTVLTGTKDTIYSGVTS

AVNVAKGAVQTGLKTTQNIATGTKNTFGSGVTSAVNVAKGAAQTGVDTAKTVLTGTKDTV

TTGLMGAVNVAKGTVQTSVDTTKTVLTGTKDTVCSGVTGAANVAKGAIQGGLDTTKSVLT

GTKDAVSTGLTGAVKLAKGTVQTGMDTTKTVLTGTKDAVCSGVTGAANVAKGAVQMGVDT

AKTVLTGTKDTVCSGVTGAANVAKGAVQTGLKTTQNIATGTKNTLGSGVTGAAKVAKGAV

QGGLDTTKSVLTGTKDAVSTGLTGAVNLAKGTVQTGVDTSKTVLTGTKDTVCSGVTGAVN

VAKGTVQTGVDTAKTVLSGAKDAVTTGVTGAVNVAKGTVQTGVDASKAVLMGTKDTVFSG

VTGAMSMAKGAVQGGLDTTKTVLTGTKDAVSAGLMGSGNVATGATHTGLSTFQNWLPSTP

ATSWGGLTSSRTTAQLAASQPGPKVLSAEQGSYFVRLGDLGPSFRQRAFEHAVSHLQHGQ

FQARDTLAQLQDCFRLIEKAQQAPEGQPRLDQGSGASAEDAAVQERVCGLLRQLHTAYSG

LVSSLQGLPAELQQPVGRARHSLCELYGIVASAGSVEELPAERLVQSREGVHQAWQGLEQ

LLEGLQHNPPLSWLVGPFALPAGGQ

The full amino acid sequence of the protein of the invention was found to have 721 of 1199 amino acid residues (60%) identical to, and 898 of 1199 amino acid residues (74%) similar to, the 1403 amino acid residue ptnr:SPTREMBL-ACC:O88492 protein from *Mus musculus* (Mouse) (S3-12).

In a search of public sequence databases, NOV19 was found to have homology to the amino acid sequences shown in the BLASTP data listed in Table 19C.

TABLE 19C

BLASTP results for NOV19

| Gene Index/ Identifier | Protein/Organism | Length (aa) | Identity (%) | Positives (%) | Expect |
|---|---|---|---|---|---|
| ptnr:SPTREMBL-ACC:Q96Q06 | KIAA1881 PROTEIN - *Homo sapiens* | 1348 | 875/993 (88%) | 922/993 (92%) | 0.0 |
| ptnr:SPTREMBL-ACC:O88492 | S3-12 - *Mus musculus* | 1403 | 721/1199 (60%) | 898/1199 (74%) | 0.0 |
| ptnr:SPTREMBL-ACC:Q98MG7 | HYPOTHETICAL GLYCINE - RICH PROTEIN MLR0587 - *Rhizobium loti* (*Mesorhizobium loti*) | 3145 | 361/969 (37%) | 406/969 (41%) | 7.9e-74 |
| ptnr:SPTREMBL-ACC:Q98MG8 | HYPOTHETICAL GLYCINE- RICH PROTEIN MLR0585 - *Rhizobium loti* (*Mesorhizobium loti*) | 2147 | 353/944 (37%) | 401/944 (42%) | 3.5e-69 |
| ptnr:SPTREMBL-ACC:Q96WU8 | HYPOTHETICAL 119.8 KDA PROTEIN - *Schizosaccharomyces pombe* (Fission yeast) | 1195 | 248/844 (29%) | 332/844 (39%) | 1.0e-42 |

A multiple sequence alignment is shown in Table 19D, with the protein of the invention being shown on line one in a ClustalW analysis comparing the protein of the invention with related protein sequences shown in Table 19C.

Table 19D. ClustalW Analysis of NOV19

1) NOV19 CG55906-01 (SEQ ID NO:58)
2) Q96Q06 (SEQ ID NO:233)
3) O88492 (SEQ ID NO:234)

```
              10        20        30        40        50        60        70        80
       ....|....|....|....|....|....|....|....|....|....|....|....|....|....|....|....|
NOV19  MSAPDEGRRDPPKPKGKPPAPMQTLGSFFGSLPGFSSARNLVANAHSSVGAKDLVCSKMSRAKDAVSSGVAS---VVDVA
Q96Q06 --------------------------------------------GAKDLVCSKMSRAKDAVSSGVAS---VVDVA
O88492 MSASGDGTRVPPKSKGK------TLSSFFGSLPGFSSARNLVSHTHSSTSTKDLQTATDPSGTPAPSSKVSTNSQMAGDA
              90       100       110       120       130       140       150       160
```

```
NOV19    KGVVQGGLDTTRSALTGTKEVVSS-----GVTGAMDMAKGAVQGGLDTSKAVLTGTKDTVSTGLTGAVNVAKGTVQAGVD
Q96Q06   KGVVQGGLDTTRSALTGTKEAVSS-----GVTGAMDMAKGAVQGGLDTSKAVLTGTKDTVSTGLTGAVNVAKGTVQAGVD
O88492   AGLLQPSEQTAGDKDMGSFSVTSSEDAFSGVFGIMDAAKGMVQGGLGATQSALVGTKEAVSGGVMGAVGVAKGLVKGGLD 170       180       190       200       210       220       230       240
         ....|....|....|....|....|....|....|....|....|....|....|....|....|....|....|
NOV19    TTKTVLTGTKDTVTTGVMGAVNLAKGTVQTGVETSKAVLTGTKDAVSTGLTGAVNVARGSIQTGVDTSKTVLTGTKDTVC
Q96Q06   TTKTVLTGTKDTVTTGVMGAVNLAKGTVQTGVETSKAVLTGTKDAVSTGLTGAVNVARGSIQTGVDTSKTVLTGTKDTVC
O88492   TSKNVLTNTKDTVTTGVMGAANVAKGTVQTGLDTTKSVVMGTKDTVATGLAGAVNVAKGTIQGGLDTTKSVVMGTKDTVT 250       260       270       280       290       300       310       320
         ....|....|....|....|....|....|....|....|....|....|....|....|....|....|....|
NOV19    SGVTGAMNVAKGTIQTGVDTSKTVLTGTKDTVCSGVTGAMNVAKGTIQTGVDTSKTVLTGTKDTVCSGVTGAMNVAKGTI
Q96Q06   SGVTSAMNVAKGTIQTGVDTSKTVLTGTKDTVCSGVTGAMNVAKGTIQTGVDTSKTVLTGTKDTVCSGVTGAMNVAKGTI
O88492   TGLTGAANVAKGVVCGGLDTTKSVVMGTKDTVTTGLTGAMNVAKGTAQMGLDTSKTVLTGTKDTVCAGATGAINVAKGAA 330       340       350       360       370       380       390       400
         ....|....|....|....|....|....|....|....|....|....|....|....|....|....|....|
NOV19    QTGVDTTKTVLTGTKNTVCSGVTGAVNLAKEAIQGGLDTTKSMVMGTKDTMSTGLTGAANVAKGAMQTGLNTTQNIATGT
Q96Q06   QTGVDTTKTVLTGTKNTVCSGVTGAVNLAKEAIQGGLDTTKSMVMGTKDTMSTGLTGAANVAKGAMQTGLNTTQNIATGT
O88492   QGGLDTTKSVLIGTKDTVTTGLTGAVNVAKGAVQGGLDTTKSVVMGTKDTVTTGLTGAMNVAKGTAQMGLCTSKTVLTGT 410       420       430       440       450       460       470       480
         ....|....|....|....|....|....|....|....|....|....|....|....|....|....|....|
NOV19    KDTVCSGVTGAMNLARGTIQTGVDTTKIVLTGTKDTVCSGVTGAANVAKGAVQGGLDTTKSVLTGTKDAVSTGLTGAVNV
Q96Q06   KDTVCSGVTGAMNLARGTIQTGVDTTKIVLTGTKDTVCSGVTGAANVAKGAVQGGLDTTKSVLTGTKDAVSTGLTGAVNV
O88492   KDTVCAGLTGAVNVAKGAAQGGLDTTKSVLMGTKDTVTTGLTGAVNVAKGTIQGGLDTTKSVVMGTKDTVTTGLTGAVNV 490       500       510       520       530       540       550       560
         ....|....|....|....|....|....|....|....|....|....|....|....|....|....|....|
NOV19    AKGTVQTGVDTTKTVLTGTKDTVCSGVTSAVNVAKGAVQGGLDTTKSVVIGTKDTMSTGLTGAANVAKGAVQTGVDTAKT
Q96Q06   AKGTVQTGVDTTKTVLTGTKDTVCSGVTSAVNVAKGAVQGGLDTTKSVVIGTKDTMSTGLTGAANVAKGAVQTGVDTAKT
O88492   AKGTVQGGLDTTKSVVMGTKDTVTTGLTGAVNVAKGAAQGGLDTTKSVVMGTKDTVTTGLTGAMNVAKGTAQMGLGTSKT 570       580       590       600       610       620       630       640
         ....|....|....|....|....|....|....|....|....|....|....|....|....|....|....|
NOV19    VLTGTKDTVTTGLVGAVNVAKGTVQTGMDTTKTVLTGTKDTIYSGVTSAVNVAKGAVQTGLKTTQNIATGTKNTFGSGVT
Q96Q06   VLTGTKDTVTTGLVGAVNVAKGTVQTGMDTTKTVLTGTKDTIYSGVTSAVNVAKGAVQTGLKTTQNIATGTKNTFGSGVT
O88492   VLTGTKDTVCAGLTGAINVAKGAAQGGLDTTKSVLMGTKDTVTTGLTGAVNVAKGTIQGGLDTTKSVVMGTKDTVTTGLT 650       660       670       680       690       700       710       720
         ....|....|....|....|....|....|....|....|....|....|....|....|....|....|....|
NOV19    SAVNVAKGAAQTGVDTAKTVLTGTKDTVTTGLMGAVNVAKGTVQTSVDTTKTVLTGTKDTVCS----------------
Q96Q06   GAVNVAKGAVQTGVDTAKTVLTGTKDTVTTGLMGAVNVAKGTVQTSVDTTKTVLTGTKDTVCSGVTGAANVAKGAVQTGV
O88492   GAVNVAKGAVCGGLDTTKSVVMGTKDTVTTGLTGAINVAKGTAQMGLDTSKTVLIGTKDTVCAGATGAINVAKGAAQGGL 730       740       750       760       770       780       790       800
         ....|....|....|....|....|....|....|....|....|....|....|....|....|....|....|
NOV19    ------------------------------------GVTGAANVAKGAIQGGLDTTKSVLTGTKDAV
Q96Q06   DTAKTVLTGTKDTVCSGVTGAVNVAKGAVQTGLKTTQNIATGTKNTLGSGVTGAANVAKGAVQGGLDTTKSVLTGTKDAV
O88492   DTTKSVLMG--------------------------TKDTVTTGLTGAINVAKGSAQGGLDTTKSVLIGTKDTV 810       820       830       840       850       860       870       880
         ....|....|....|....|....|....|....|....|....|....|....|....|....|....|....|
NOV19    STGLTGAVKLAKGTVQTGMDTTKTVLTGTKDAVCSGVTGAANVAKGAVQMGVDTAKTVLTGTKDTVCSGVTGAANVAKGA
Q96Q06   STGLTGAVNLAKGTVQTGMDTTKTVLTGTKDAVCSGVTGAANVAKGAVQTGVDTAKTVLTGTKDTVTTGLMGAVNVAKGT
O88492   TTGLTGAINVAKGTVQTGLDTSQRVLTGTKDNVYAGVTGAVNVAKGTIQGGLDTTKSVVMGTKDTVTTGLTGAVNVAKGA 890       900       910       920       930       940       950       960
         ....|....|....|....|....|....|....|....|....|....|....|....|....|....|....|
NOV19    VQTGLKTTQNIATGTKNTLGSGVTGAAKVAKGAVQGGLDTTKSVLTGTKDAVSTGLTGAVNLAKGTVQTGVDTSKTVLTG
Q96Q06   VQTSVDTTKTVITGTKDTVCSGVTGAANVAKGAVQGGLDTTKSVLTGTKDTVSTGLTGAVNLAKGTVQTGVDTSKTVLTG
O88492   VCGGLDTTKSVVMGTKDTVTTGLTGAMNVAKGTAQMGIDTSKIVLTGTKDTVCAGLTGAINVAKGATCGGLDTTKSVLMG 970       980       990       1000      1010      1020      1030      1040
         ....|....|....|....|....|....|....|....|....|....|....|....|....|....|....|
NOV19    TKDTVCSGVTGAVNVAKGTVQTGVDTAKTVLSGAKDAVTTGVTGAVNVAKGTVQTGVDASKAVLMGTKDTVFSGVTGAMS
Q96Q06   TKDTVCSGVTGAVNVAKGTVQTGVDTAKTVLSGAKDAVTTGVTGAVNVAKGTVQTGVDASKAVLMGTKDTVFSGVTGAMS
O88492   TKDTVTTGLTGAINVAKGAAQGGLDTTKSVLLGTKETVTTGLTGAANVAKETVQMGLDTSKNILMDTKDSICAGATGAIT 1050      1060      1070      1080      1090      1100      1110      1120
         ....|....|....|....|....|....|....|....|....|....|....|....|....|....|....|
NOV19    MAKGAVQGGLDTTKTVLTG-------------------------------------------TKDAVSAGLMGSGN
Q96Q06   MAKGAVCGGLDTTKTVLTG-------------------------------------------TKDAVSAGLMGSGN
O88492   VVKGAACGGLDTSNAALTGIMDTAKGTVQTSLDTSKHMLIGMKDTVCAGVTSAMNMAKGIHKNTDTIKDTQSSVLAHSGN 1130      1140      1150      1160      1170      1180      1190      1200
         ....|....|....|....|....|....|....|....|....|....|....|....|....|....|....|
NOV19    VATGATHTGLSTFQNWLPSTPATSWGGLTSSRTT----------------------------------------
Q96Q06   VATGATHTGLSTFQNWLPSTPATSWGGLTSSRTTDNGGEQTALSPQERPPSGISTPPDVLSVGPEPAWEAAATTKGLAID
O88492   VATNAIHTGVHTVPSSLSGSHSIICHEPSIYRATNECVGHAILTSTESLCCETSSFSDKYGLG--HVTEPRADTKTLVSG
```

```
              1210      1220      1230      1240      1250      1260      1270      1280
           ....|....|....|....|....|....|....|....|....|....|....|....|....|....|....|....|
NOV19      ------------------------------------------------AQLAASQPGPKVLSAEQGSYFVRLGDLG
Q96Q06     VATPTQGAAPGREDTGLLTTTHGPEEAPRLAMLQNELEGLGDIFHPMNAEEQAQLAASQPGPKVLSAEQGSYFVRLGDLG
O88492     MASSACAATRSVEECQLAATG-------PAALPLELKGLGDIFQPMTTEEQAQLAVSESGPRVLSADRGSYYIRLGDLA 1290      1300      1310      1320      1330      1340      1350      1360
           ....|....|....|....|....|....|....|....|....|....|....|....|....|....|....|....|
NOV19      PSFRQRAFEHAVSHLQHGQFQARDTLAQLQDCFRLIEKAQQAPEGQPRLDQGSGASAEDAAVQE-------RVCGLLRC
Q96Q06     PSFRQRAFEHAVSHLQHGQFQARDTLAQLQDCFRLIEKAQQAPEGQPRLDQGSGASAEDAAVQEERDAGVLSRVCGLLRC
O88492     PSFRQRAFEHALSHIQHNQFQARAAVAQLQEAFQMTDMTMEAACKLCSDCSLNTMVEAVGSHEMRASVAQDRLCTLAHC 1370      1380      1390      1400      1410      1420      1430      1440
           ....|....|....|....|....|....|....|....|....|....|....|....|....|....|....|....|
NOV19      LHTAYSGLVSSLQGLPAELQQPVGRARHSLCELYGIVASAGSVEELPAERLVQSREGVHQAWQGLEQLLEGLQHNPPLSW
Q96Q06     LHTAYSGLVSSLQGLPAELQQPVGRARHSLCELYGIVASAGSVEELPAERLVQSREGVHQAWQGLEQLLEGLQHNPPLSW
O88492     LHAAYSSLVQSLQGLP-EVQQQAGQARHSLCKLYGIVSSEAG-SELQTEQLAQSSAGVVEAWQGLEVLLEKLQQNPPLSW

1450
           ....|....|...
NOV19      LVGPFALPAGGQ-
Q96Q06     LVGPFALPAGGQ-
O88492     LVGPFTSMPCGCL
```

Other BLAST results include sequences from the Patp database, which is a proprietary database that contains sequences published in patents and patent publications. Patp results include those listed in Table 19E.

TABLE 19E

Patp BLASTP Analysis for NOV19

| Sequences producing High-scoring Segment Pairs | Protein/Organism | Length (aa) | Identity (%) | Positive (%) | E Value |
| --- | --- | --- | --- | --- | --- |
| patp: AAY95851 | Autoantigen diagnostic of endometriosis - *Homo sapiens* | 439 | 431/436 (98%) | 432/436 (99%) | 3.8e−220 |
| patp: AAY44931 | Mammalian adipose differentiation associated protein - Mammalia | 286 | 192/200 (96%) | 192/200 (96%) | 9.7e−99 |
| patp: AAY48492 | Human breast tumour-associated protein 37 - *Homo sapiens* | 324 | 225/324 (69%) | 239/324 (73%) | 9.4e−98 |
| patp: AAY44929 | Human adipose differentiation associated protein-1 - *Homo sapiens* | 213 | 192/200 (96%) | 192/200 (96%) | 6.6e−97 |
| patp: AAY44930 | Human adipose differentiation associated protein-2 - *Homo sapiens* | 206 | 192/200 (96%) | 192/200 (96%) | 6.6e−97 |

Significant domains of NOV19 are summarized in Table 19F.

| Table 19F. Domain Analysis of NOV19 |
|---|
| Pfam analysis |
| Model    Domain   seq-f seq-t   hmm-f hmm-t    score  E-value |
| -------  -------  ----- -----   ----- -----    -----  ------- |

```
     LEA           1/4      46   115 ..      1    75 []    18.5    0.085
     LEA           2/4     306   379 ..      1    75 []     1.1    2
     LEA           3/4     475   548 ..      1    75 []     5.1    0.96
     LEA           4/4     772   863 ..      1    75 []    -1.3    3
     perilipin     1/1     844  1209 ..      1   411 []   -20.1    0.00018

Alignments of top-scoring domains:
        LEA: domain 1 of 4, from 46 to 115: score 18.5, E = 0.085
   (SEQ ID NO:235)           ekAketadsAkekAseakdaakdKAeeAkdaakeKAeeAkdkakekk
                              +   ++|   +   |+|  ||||+   ++ + |  ||
++  |++  +
        NOV19    (SEQ ID NO:407)   46
HSSVGAKDLVCSKMSRAKDAVSSGVASVVDVAKGVVQGGLDTTRSA- 91 ageaKDktgnkakekaeeaKdkasdakd<-*
                     +|+      ++++    |+|+|++|++
                  92 LTGTKE----VVSSGVTGAMDMAKGAVQ    115

LEA: domain 2 of 4, from 306 to 379: score 1.1, E = 2
   (SEQ ID NO:236)           ekAketadsAkekAse....akdaakdKAeeAkdaakeKAeeAkdka
                                                ||  |  ++  ++++   +++|+++   +
+|  +  |||+  ++   |++
        NOV19    (SEQ ID NO:408)   306
NVAKGTIQTGVDTTKTVltgTKNTVCSGVTGAVNLAKEAIQGGLDTT 352 kekkageaKDktgnkakekaeeaKdkasdakd<-*
                     |    +   +||      + +        |  + |++|++
                 353 KSM-VMGTKD----TMSTGLTGAANVAKGAMQ    379

LEA: domain 3 of 4, from 475 to 548: score 5.1, E = 0.96
   (SEQ ID NO:237)           ekAketadsAkekAseakdaakdKAeeAkdaakeKAeeAkdkakekk
                                                ++++   |++|   +||++   +  | + ||
+ ++  |++|
        NOV19    (SEQ ID NO:409)   475
GTVQTGVDTTKTVLTGTKDTVCSGVTSAVNVAKGAVQGGLDTTKSV- 520 ageaKDktg.nkakekaeeaKdkasdakd<-*
                     +  +||++++++ + ++|   ||++++   +|
                 521 VIGTKDTMStGLT-GAANVAKGAVQTGVD    548

LEA: domain 4 of 4, from 772 to 863: score -1.3, E = 3
   (SEQ ID NO:238)           ekAketadsAkekAseakdaakdKAeeAkdaakeKAee.........
                                                ++++   |+||   +||++   +  +|++  ||
+  +  +  +++++
        NOV19    (SEQ ID NO:410)   772
GAVQMGVDTAKTVLTGTKDTVCSGVTGAANVAKGAVQTglkttqnia 818

.............AkdkakekkageaKDktgnkakekaeeaKdkasdakd
                                 ++++++  +++  ++|+    ||++  ++  +     ++|++    +|++|
                 819 tgtkntlgsgvtgAAKVAKGA-VQGGLD----TTKSVLTGTKDAVSTGLT    863 perilipin: domain 1 of 1, from 844 to 1209: score -20.1, E = 0.00018
   (SEQ ID NO:239)           matavedlpqqesVvd..RvasLPlVsstikcdlVsaaYdstKenyp
                                                 +  |++ +  |     +++|  +++ +     |   +|
|++   |   +|   +
        NOV19    (SEQ ID NO:411)   844   LDTTKSVLTGTKDAVStgLTGAVNLAKGT-----
VQTGVDTSKTVLT 885 lvkGvksVceaaekGvetitsaAvtsaqPivkkLepqIavaneyackGLD
                     +  +||     ||  +++++|   ++|           +      |  +++     |
                 886 G--TKDTVC----SGVTGAVNVAKGTVQ-------TGVDTAKTVLSGAKD    922 kLEeklPiLqqPpekivanaKgavtgakdavstrvesakdsVvqpilerv
```

```
                ++    +  |+ ||| |   +||    + + ||+|  + +++++
      923 -------AVTTGVTGAVNVAKGTVQTGVDASKAVLMGTKDTVFSGVTGAM 965

DkvKgAvqagvEstKsvvtgsantVlgsrvgqlassGVDt.aLgksEklv
          ||||+|++ || | ||+     | +    | ++|+ | |+|+ +
      966 SMAKGAVQGGLDTTKTVLTGTKDAVSA---GLMGSGNVATgATHTGLSTF 1012 eqylP.............pteeElekeAkkvegfDskkvqqqrqkp.sal
           + ||+++ ++ ++ +++  | + |+   +++ |+++ +    ++++|++
     1013 QNWLPstpatswggltssRTTAQLA---ASQPGPKVLS-----AEQgSYF 1054 vrlgslSekLrrrayqqalgrvraaKqrSqeaihqLqsvaeLietakkgv
          ||||  |   |+|| ++|++ ++ + ++  +++|||  ++|||+|++
     1055 VRLGDLGPSFRQRAFEHAVSHLQHGQFQARDTLAQLQDCFRLIEKAQQAP 1104 sqanqkvsraqdkLyvlWlewkassgedpedesdtepeqiEsrilll.tr
                                       |++    ++  |  ++ ++
     1105 EGQPR----------------------LDQGS--GASAEDAAVQErVC 1128 elaqqlvaalktllssiqgipqnlqdtvqqvgsmsgdaysafrsraasfk
          |++||  +|  +|+||+||+|  ||  |  +++ +  ++|  +  | | |
     1129 GLLRQLHTAYSGLVSSLQGLPAELQQPVGRARHSLCELYGIVAS-AGSVE 1177 etsdglltsskgrvaslkealdevmdyvVsnt<-*
          |+++   |  +|++  | + +|    + + |
     1178 ELPAERLVQSREGVHQAWQGLEQLLEGLQHNP    1209
```

The S3-12 disclosed in this invention is expressed in at least the following tissues: colon, lung. In addition, the sequence is predicted to be expressed in the following tissues because of the expression pattern of (GENBANK-ID: gb:GENBANK-ID:AF064748|acc:AF064748.1) a closely related *Mus musculus* S3-12 mRNA, complete cds homolog in species *Mus musculus* adipocytes.

The nucleic acids and proteins of the invention are useful in potential diagnostic and therapeutic applications implicated in various diseases and disorders described below and/or other pathologies. For example, the compositions of the present invention will have efficacy for treatment of patients suffering from: cancer, trauma, regeneration (in vitro and in vivo), viral/bacterial/parasitic infections, Hirschsprung's disease, Crohn's Disease, appendicitis, systemic lupus erythematosus, autoimmune disease, asthma, emphysema, scleroderma, allergy, ARDS and other diseases, disorders and conditions of the like.

immunoassay to detect the presence of autoantibodies immunospecific for them. The presence of such antibodies is indicative of the presence of endometriosis. High clinical sensitivity and specificity, as well as a means for assessing disease progression, prognosis and therapeutic efficacy, are achieved. Polynucleotides encoding the autoantigens can be used in the recombinant production of the autoantigens.

NOV20

A disclosed NOV20 nucleic acid of 810 nucleotides (also referred to as CG55906-02) (SEQ ID NO:59) encoding a novel S3-12-like protein is shown in Table 20A. An open reading frame was identified beginning with an ATG initiation codon at nucleotides 123–125 and ending with a TGA codon at nucleotides 792–794. Putative untranslated regions upstream from the initiation codon and downstream from the termination codon are underlined. The start and stop codons are in bold in Table 20A.

TABLE 20A

NOV20 nucleotide sequence

AGGCCTGCAGGTGGGTGTCGGGCTGCTCAGGCTTTCAGTGGGGAGTGGGTGTGGGATGGG (SEQ ID NO:59)

AGGCTAGGGAACCCCCATTCACGCACCTTCTCTGCCCCCTTCCAGCTTCTCACGTTCTCA

CTATGTCTGCTCCAGACGAAGGGAGACGGGATCCCCCCAAACCGAAGGGCAAGACCCTGG

GCAGCTTCTTTGGGTCCCTGCCTGGCTTCAACTCTGCCCGGAACCTGGTGGCCAACGCAC

ATAGCTCGGCGAGAGCCCGGCCGGCCGCTGACCCCACAGGAGCGCCTGCTGCCGAGGCTG

CCCAACCACAGGCTCAGGTGGCTGCCCACCCAGAGCAGACGGCCCCATGGACGGAGAAGG

AGCTGCAACCTTCGGAAAAGATTGAAAAGGCCCAGCAGGCTCCAGAAGGGCAGCCACGTC

TGGACCAGGGCTCAGGTGCCAGTGCGGAGGACGCTGCTGTCCAGGAGGAGCGGGATGCCG

GGGTTCTGTCCAGGGTCTGCGGCCTTCTCCGGCAGCTGCACACGGCCTACAGTGGCCTGG

TCTCCAGCCTCCGGGGCCTGCCCGCCGAGCTCCAGCAGCCAGTGGGGCGGGCGCGGCACA

GCCTCTGTGAGCTCTATGGCATCGTGGCCTCAGCTGGCTCTGTAGAGGAGCTGCCCGCAG

AGCGGCTGGTGCAGAGCCGCGAGGGTGTGCACCAGGCTTGGCAGGGGTTAGAGCAGCTGC

TGGAGGGCCTACAGCACAATCCCCCGCTCAGCTGGCTGGTAGGGCCCTTCGCCTTGCCCG

CTGGCGGGCAGTAGCTGTAGGAGCCTGCAG

This novel human protein has best homology to a novel mouse protein S3-12 cloned from mouse adipocytes using an antibody based subtractive hybridization protocol. It also contains tandem repeats of a threonine-rich 33-amino acid motif; which are similar to 33-amino acid motif in adipocyte differentiation-related protein (ADRP).

This sequence has 99% homology to a patented partial cDNA, Acc No A50242, that has been described as encoding an autoantigen diagnostic of endometriosis (see Y95851). These autoantigens (see Y95843-55) can be used in non-invasive assays to detect endometriosis. The assays are based on the binding of the autoantigens by autoantibodies in a body fluid of a patient. The autoantigens may be immobilized on solid supports and used in an immunoprecipitation assay, an enzyme linked immunosorbant assay (ELISA), a depletion enzyme-linked immunosorbant assay (dELISA), a Western blot, a particle agglutination assay, a luminescent oxygen-channeling immunoassay, a proximity-based immunosorbant assay and/or a biosensor-based The S3-12-like NOV20 gene disclosed in this invention maps to chromosome 19.

In a search of sequence databases, it was found, for example, that the nucleic acid sequence of this invention has 349 of 526 bases (66%) identical to a gb:GENBANK-ID: AF064748|acc:AF064748.1 mRNA from *Mus musculus* (*Mus musculus* S3-12 mRNA, complete cds).

A disclosed NOV20 polypeptide (SEQ ID NO:60) encoded by SEQ ID NO:59 has 223 amino acid residues and is presented in Table 20B using the one-letter code. The SignalP, Psort and/or Hydropathy results predict that NOV20 has no signal peptide and is likely to be localized in the cytoplasm with a certainty of 0.6500 predicted by PSORT. The protein of this invention may be membrane-associated, based on its homology to mouse S3-12 (Nat Biotechnol 1998 June; 16(6):581–6). In an alternative embodiment, NOV20 is likely to be localized to the lysosome (lumen) with a certainty of 0.1916, or to the mitochondrial matrix space with a certainty of 0.1000.

TABLE 20B

| NOV20 protein sequence |
| --- |
| MSAPDEGRRDPPKPKGKTLGSFFGSLPGFNSARNLVANAHSSARARPAADPTGAPAAEAA   (SEQ ID NO:60) |
| QPQAQVAAHPEQTAPWTEKELQPSEKIEKAQQAPEGQPRLDQGSGASAEDAAVQEERDAG |
| VLSRVCGLLRQLHTAYSGLVSSLRGLPAELQQPVGRARHSLCELYGIVASAGSVEELPAE |
| RLVQSREGVHQAWQGLEQLLEGLQHNPPLSWLVGPFALPAGGQ |

NOV19 and NOV20 are both members of the S3-12 protein family and have similar protein sequence at the N-terminus and C-terminus. The relationship between the NOV19 and NOV20 protein sequences is shown in Table 20C.

Table 20C. ClustalW Alignment of NOV19 and NOV20

```
                  10        20        30        40        50        60        70        80
             ....|....|....|....|....|....|....|....|....|....|....|....|....|....|....|....|
CG55906_01   MSAPDEGRRDPPKPKGKPPAPMQTLGSFFGSLPGFSSARNLVANAHSSVGAKDLVCSKMSRAKDAVSSGVASVVDVAKGV
CG55906_02   MSAPDEGRRDPPKPKGK-----TLGSFFGSLPGFNSARNLVANAHSSARAR-----------------------------

90       100       110       120       130       140       150       160
             ....|....|....|....|....|....|....|....|....|....|....|....|....|....|....|....|
CG55906_01   VQGGLDTTRSALTGTKEVVSSGVTGAMDMAKGAVQGGLDTSKAVLTGTKDTVSTGLTGAVNVAKGTVQAGVDTTKTVLTG
CG55906_02   --------------------------------------------------------------------PAADP------

170       180       190       200       210       220       230       240
             ....|....|....|....|....|....|....|....|....|....|....|....|....|....|....|....|
CG55906_01   TKDTVTTGVMGAVNLAKGTVQTGVETSKAVLTGTKDAVSTGLTGAVNVARGSIQTGVDTSKTVLTGTKDTVCSGVTGAMN
CG55906_02   --------------------------------------------------------------------------------

250       260       270       280       290       300       310       320
             ....|....|....|....|....|....|....|....|....|....|....|....|....|....|....|....|
CG55906_01   VAKGTIQTGVDTSKTVLTGTKDTVCSGVTGAMNVAKGTIQTGVDTSKTVLTGTKDTVCSGVTGAMNVAKGTIQTGVDTTK
CG55906_02   --------------------------------------------------------------------------------

330       340       350       360       370       380       390       400
             ....|....|....|....|....|....|....|....|....|....|....|....|....|....|....|....|
CG55906_01   TVLTGTKNTVCSGVTGAVNLAKEAIQGGLDTTKSMVMGTKDTMSTGLTGAANVAKGAMQTGLNTTQNIATGTKDTVCSGV
CG55906_02   --------------------------------------------------------------------------------

410       420       430       440       450       460       470       480
             ....|....|....|....|....|....|....|....|....|....|....|....|....|....|....|....|
CG55906_01   TGAMNLARGTIQTGVDTTKIVLTGTKDTVCSGVTGAANVAKGAVQGGLDTTKSVLTGTKDAVSTGLTGAVNVAKGTVQTG
CG55906_02   --------------------------------TGAP-------------------------------------------

490       500       510       520       530       540       550       560
             ....|....|....|....|....|....|....|....|....|....|....|....|....|....|....|....|
CG55906_01   VDTTKTVLTGTKDTVCSGVTSAVNVAKGAVQGGLDTTKSVVIGTKDTMSTGLTGAANVAKGAVQTGVDTAKTVLTGTKDT
CG55906_02   --------------------------------------------------------------------------------

570       580       590       600       610       620       630       640
             ....|....|....|....|....|....|....|....|....|....|....|....|....|....|....|....|
CG55906_01   VTTGLVGAVNVAKGTVQTGMDTTKTVLTGTKDTIYSGVTSAVNVAKGAVQTGLKTTQNIATGTKNTFGSGVTSAVNVAKG
CG55906_02   --------------------------------------------------------------------------------

650       660       670       680       690       700       710       720
             ....|....|....|....|....|....|....|....|....|....|....|....|....|....|....|....|
CG55906_01   AAQTGVDTAKTVLTGTKDTVTTGLMGAVNVAKGTVQTSVDTTKTVLTGTKDTVCSGVTGAANVAKGAICGGLDTTKSVLT
CG55906_02   ---------------------------------------------------------------AAEAAC----------

730       740       750       760       770       780       790       800
             ....|....|....|....|....|....|....|....|....|....|....|....|....|....|....|....|
CG55906_01   GTKDAVSTGLTGAVKLAKGTVQTGMDTTKTVLTGTKDAVCSGVTGAANVAKGAVQMGVDTAKTVLTGTKDTVCSGVTGAA
CG55906_02   ----------------------------------------------P---------QM-------------------A 810       820       830       840       850       860       870       880
             ....|....|....|....|....|....|....|....|....|....|....|....|....|....|....|....|
CG55906_01   NVAKGAVQTGLKTTQNIATGTKNTLGSGVTGAAKVAKGAVQGGLDTTKSVLTGTKDAVSTGLTGAVNLAKGTVQTGVDTS
CG55906_02   QVAAHPEQT-----------------------------------------------------------------------

890       900       910       920       930       940       950       960
```

```
              ....|....|....|....|....|....|....|....|....|....|....|....|....|....|....|....|
CG55906_01    KTVLTGTKDTVCSGVTGAVNVAKGTVQTGVDTAKTVLSGAKDAVTTGVTGAVNVAKGTVQTGVDASKAVLMGTKDTVFSG
CG55906_02    --------------------------------------------------------------------------------

970       980       990      1000      1010      1020      1030      1040
              ....|....|....|....|....|....|....|....|....|....|....|....|....|....|....|....|
CG55906_01    VTGAMSMAKGAVQGGLDTTKTVLTGTKDAVSAGLMGSGNVATGATHTGLSTFQNWLESTPATSWGGLTSSRTTAQLAASC
CG55906_02    -------------------------------------------------------AE-----W-------TEKEL---C 1050      1060      1070      1080      1090      1100      1110      1120
              ....|....|....|....|....|....|....|....|....|....|....|....|....|....|....|....|
CG55906_01    PGPKVLSAEQGSYFVRLGDLGPSFRQRAFEHAVSHLQHGQFQARDTLAQLQDCFRLIEKAQQAPEGQPRLDQGSGASAED
CG55906_02    PS--------------------------EK--------------------------IEKAQQAPEGQPRLDQGSGASAED 1130      1140      1150      1160      1170      1180      1190      1200
              ....|....|....|....|....|....|....|....|....|....|....|....|....|....|....|....|
CG55906_01    AAVQE--------RVCGLLRQLHTAYSGLVSSLQGLPAELQQPVGRARHSLCELYGIVASAGSVEELPAERLVQSREGVH
CG55906_02    AAVQEERDAGVLSRVCGLLRQLHTAYSGLVSSLRGLPAELQQPVGRARHSLCELYGIVASAGSVEELPAERLVQSREGVH 1210      1220      1230
              ....|....|....|....|....|....|
CG55906_01    QAWQGLEQLLEGLQHNPPLSWLVGPFALPAGGQ  (SEQ ID NO:58)
CG55906_02    QAWQGLEQLLEGLQHNPPLSWLVGPFALPAGGQ  (SEQ ID NO:60)
```

The full amino acid sequence of the NOV20 protein of the invention was found to have 75 of 142 amino acid residues (52%) identical to, and 94 of 142 amino acid residues (66%) similar to, the 1403 amino acid residue ptnr:SPTREMBL-ACC:O88492 protein from *Mus musculus* (Mouse) (S3-12).

In a search of public sequence databases, NOV20 was found to have homology to the amino acid sequences shown in the BLASTP data listed in Table 20D.

Table 20E. ClustalW Analysis of NOV20

1) NOV20 CG55906-02 (SEQ ID NO:60)
2) Q96Q06 (SEQ ID NO:240)
3) O88492 (SEQ ID NO:241)

```
                    10         20         30         40         50         60         70         80
             ....|....|....|....|....|....|....|....|....|....|....|....|....|....|....|....|
NOV20        --------------------------------------------------------------------------------
Q96Q06       ----------------------------------------GAKDLVCSKMSRAKDAVSSGMAS---VVDVAKGVVCG
O88492       MSASGDGTRVPPKSKGKTLSSFFGSLPGFSSARNLVSHTHSSTSTKDLQTATDPSGTPAPSSKVSTNSQMAGDAAGLLCP 90        100        110        120        130        140        150        160
             ....|....|....|....|....|....|....|....|....|....|....|....|....|....|....|....|
NOV20        --------------------------------------------------------------------------------
Q96Q06       GLDTTRSALTC----TKEAVSSGVTGAMDMAKGAVQGGLDTSKAVLTGTKDTVSTGLTGAVNVAKGTVQAGVDTTKTVL
O88492       SEQTAGDKDMGSFSVTSSEDAFSGVFGIMDAAKGMVQGGLGATQSALVGTKEAVSGGVMGAVGVAKGLVKGGLDTSKNVL 170        180        190        200        210        220        230        240
             ....|....|....|....|....|....|....|....|....|....|....|....|....|....|....|....|
NOV20        --------------------------------------------------------------------------------
Q96Q06       TGTKDTVTTGVMGAVNLAKGTVQTGVPTSKAVLTGTKDAVSTGLTGAVNVARGSICTGVDTSKTVLTGTKDTVCSGVTSA
O88492       TNTKDTVTTGVMGAANLAKGTVQTGLDTTKSVVMGTKDTVATGLAGAVNVAKGTIQGGLDTTKSVVMGTKDTVTTGLTGA 250        260        270        280        290        300        310        320
             ....|....|....|....|....|....|....|....|....|....|....|....|....|....|....|....|
NOV20        --------------------------------------------------------------------------------
Q96Q06       MNVAKGTICTGVDTSKTVLTGTKDTVCSGVTGAMNVAKGTICTGVDTSKTVLTGTKDTVCSGVTGAMNVAKGTICTGVDT
O88492       ANVAKGVVQGGLDTTKSVVMGTKDTVTTGLTGAMNVAKGTAQMGIDTSKTVLTGTKDTVCAGATGAINVAKGAAQGGLDT 330        340        350        360        370        380        390        400
             ....|....|....|....|....|....|....|....|....|....|....|....|....|....|....|....|
NOV20        --------------------------------------------------------------------------------
Q96Q06       TKTVLTGTKNTVCSGVTGAVNLAKEAIQGGLDTTKSVVMGTKDTMSTGLTGAANVAKGAMCTGLNTTQNLATGTKDTVCS
O88492       TKSVLIGTKDTVTTGLTGAVNVAKGAVQGGLDTTKSVVMGTKDTVTTGLTGAMNVAKGTAQMGLGTSKTVLTGTKDTVCA 410        420        430        440        450        460        470        480
             ....|....|....|....|....|....|....|....|....|....|....|....|....|....|....|....|
NOV20        --------------------------------------------------------------------------------
Q96Q06       GVTGAMNLARGTIQTGVDTTKIVLTGTKDTVCSGVTGAANVAKGAVQGGLDTTKSVLTGTKDAVSTGLTGAVNVAKGTVC
O88492       GLTGAINVAKGAAQGGLDTTKSVLMGTKDTVTTGLTGAVNVAKGTIQGGLDTTKSVVMGTKDTVITGLTGAVNVAKGTIC 490        500        510        520        530        540        550        560
             ....|....|....|....|....|....|....|....|....|....|....|....|....|....|....|....|
NOV20        --------------------------------------------------------------------------------
Q96Q06       TGVDTTKIVLTGTKDTVCSGVTSAVNVAKGAVQGGLDTTKSVVIGTKDTMSTGLTGAANVAKGAVCTGVDTAKTVLTGTK
O88492       GGLDTTKSVVMGTKDTVTTGLTCAVNVAKGAAQGGLDTTKSVVVGTKDTVTTGLTGAMNVAKGTAQMGLGTSKTVLTGTF 570        580        590        600        610        620        630        640
             ....|....|....|....|....|....|....|....|....|....|....|....|....|....|....|....|
NOV20        --------------------------------------------------------------------------------
Q96Q06       DTVTTGLVGAMNVAKGTVCTGMDTTKIVLTGTKDTIYSGVTSAVNVAKGAVCTGLKTTQNLATGTKNTFGSGVTGAVNVA
O88492       DTVCAGLTGAINVAKGAACGLDTTKSVLMGTKDTVTTGLTGAVNVAKGTICGGLDTTKSVVMGTKDTVTTGLTGAVNVA 650        660        670        680        690        700        710        720
             ....|....|....|....|....|....|....|....|....|....|....|....|....|....|....|....|
NOV20        --------------------------------------------------------------------------------
Q96Q06       KGAVCTGVDTAKTVLTGTKDTVTTGLMGAVNVAKGTVQTSVDTTKTVLTGTKDTVCSGVTGAANVAKGAVCTGVDIAKTV
O88492       KGAVCGGLDTTKSVVMGTKDTVTTGLTGAINVAKGTAQMGIDTSKTVLTGTKDTVCAGATGAINVAKGAAQGGLDTTKSV 730        740        750        760        770        780        790        800
             ....|....|....|....|....|....|....|....|....|....|....|....|....|....|....|....|
NOV20        --------------------------------------------------------------------------------
Q96Q06       LTGTKDTVCSGVTGAVNVAKGAVCTGLKTTQNLATGTKNTLGSGVTGAANVAKGAVCGGLDTTKSVLTGTKDAVSTCLTC
O88492       LMGTKDTVTTGLTGAINVAKCSAQGGLDTTKSVLIGTKDTVTTGLTGALNVAKGTVCTGLDTSQRVLTGTKDNVYACVTG 810        820        830        840        850        860        870        880
             ....|....|....|....|....|....|....|....|....|....|....|....|....|....|....|....|
NOV20        --------------------------------------------------------------------------------
Q96Q06       AVNLAKGTVCTGMDTTKTVLTGTKDAVCSGVTGAANVAKGAVCTGVDTAKTVLTGTKDTVTTGLMGAVNVAKGTVQTSVD
```

```
088492  AVNVAKGTICGGLDTTKSVVMGTKDTVTLGLTGAVNVAKGAVCGGLDTTKSVVMGTKDTVTTGLTGAVNVAKGTAQMGIL 890       900       910       920       930       940       950       960
             ....|....|....|....|....|....|....|....|....|....|....|....|....|....|....|
NOV20    ------------------------------------------------------------------------------
Q96Q06   TTKTVLTGTKDTVCSGYTGAANVAKGAVQGGLDTTKSVLTGTKDTVSTGLTGAVNLAKGTVCTGVDTSKLVLTGTKDTVC
088492   TSKTVLTGTKDTVCAGETGAINVAKGATQGGLDTTKSVLMGTKDTVITGLTGAINVAKGAAQGGLDTTKSVLLGTKDTVT 970       980       990       1000      1010      1020      1030      1040
             ....|....|....|....|....|....|....|....|....|....|....|....|....|....|....|
NOV20    ------------------------------------------------------------------------------
Q96Q06   SGVTGAVNVAPGTVCTGVDTAKTVLSGAKDAVTTGVTGAVNVAK---------------------GTVQTGVDASKAVL
088492   TGLTGAANVAKETVCMGLDTSKNILMDTKDSICAGATGAITVVKGAAQGGLDTSNAALTGTMDTAKGTVQTSLDTSKHML 1050      1060      1070      1080      1090      1100      1110      1120
             ....|....|....|....|....|....|....|....|....|....|....|....|....|....|....|
NOV20    -------------MSAPD---EGRREPPK-------------------PKGKT---LGSEFGSLF--------GFNSA
Q96Q06   MGTKDTVFSGVTGAMSMAKGAVQGGLDTTPTVLTGTKDAVSAGLMGSGNVATGATHTGLSTEQNWLPSIPATSWGGLTSS
088492   TGMKDTVCAGVTSAMAMAKG-IHKNTDTTR-------DTQSSVLAHSGNVATNAIHTGVHTVPSSLSGSHSIICHEPSIY 1130      1140      1150      1160      1170      1180      1190      1200
             ....|....|....|....|....|....|....|....|....|....|....|....|....|....|....|
NOV20    RN--------------------------------------LVANAHSSAR-AREAADPTG------------AF---
Q96Q06   RITDNGGEQTALSPQEAPFSGISTPPDVLSVGPEPAWEAAPITKGLATDVAIFTQGAAEGREDTGLLTTTHGPEEAERLA
088492   RATNHCVGHAILISTESLCCETSSFSDKYGLG--HVTEPRADTKTLVSGMASSACAATRSVEECG-------QLAATGFA 1210      1220      1230      1240      1250      1260      1270      1280
             ....|....|....|....|....|....|....|....|....|....|....|....|....|....|....|
NOV20    -------------AAEAAQPQACVAAHP--------ECTAPWTEK-ELQPSEK------------------------
Q96Q06   MLQNELEGLGDIFHPMNAFFQAQLAASQPGPKVLSAEQGSYEVRLGDLGPSFRQRAFEHAVSHLQHGQFQARDTIAQLCD
088492   ALPDELKGLGDIFQPMTTEEQAQLAVSESGPRVLSADRGSYYIRLGDLAPSFRQRAFEHALSHIQHNQFQARAAVAQLQE 1290      1300      1310      1320      1330      1340      1350      1360
             ....|....|....|....|....|....|....|....|....|....|....|....|....|....|....|
NOV20    ----IEKAQQAPEGQPRLDQGSGASAEDAAVQEERDAGVLSRVCGLLRQLHTAYSGLVSSLRGLPAELQQPVGRARHSLC
Q96Q06   CFRLIEKAQQAPEGQPRLDQGSGASAEDAAVQEERDAGVLSRVCGLLRQLHTAYSGLVSSLQGLPAELQQPVGRARHSLC
088492   APQMTDMTMEAACCKLCSDCSLNTMVEAVGSHEMRASVAQDRLCTLAHQLHAAYSSLVISLQGLP-EVQCQACQARHSLC 1370      1380      1390      1400      1410      1420
             ....|....|....|....|....|....|....|....|....|....|....|..
NOV20    ELYGIVASAGSVEELPAERLVQSREGVHQAWQGLEQLLEGLQHNPPLSWLVGPFALPAGGC
Q96Q06   ELYGIVASAGSVEELPAERLVQSREGVHQAWQGLEQLLEGLQHNPPLSWLVGPFALPAGGC-
088492   KLYGEVSSEAG-SELQTEQLAQSSAGVVEAWQGLEVLLEKLCQNPPLSWLVGPFTSMPCGCL
```

A multiple sequence alignment is shown in Table 20E, with the proteins of the invention being shown on lines one and two in a ClustalW analysis comparing the protein of the invention with related protein sequences shown in Table 20D.

TABLE 20D

BLASTP results for NOV20

| Gene Index/ Identifier | Protein/Organism | Length (aa) | Identity (%) | Positives (%) | Expect |
|---|---|---|---|---|---|
| ptnr: SPTREMBL-ACC: Q96Q06 | KIAA1881 PROTEIN - Homo sapiens | 1348 | 141/156 (90%) | 145/156 (92%) | 1.6e−67 |
| ptnr: SPTREMBL-ACC: O88492 | S3-12 - Mus musculus | 1403 | 75/142 (52%) | 94/142 (66%) | 9.9e−28 |
| ptnr: SWISSPROT-ACC: O60664 | Cargo selection protein TIP47 (47 kDa mannose 6-phosphate receptor - binding protein) (47 kDa MPR-binding protein) (Placental protein 17) - Homo sapiens | 434 | 55/197 (27%) | 95/197 (48%) | 3.5e−10 |
| ptnr: SPTREMBL-ACC: Q9BS03 | CARGO SELECTION PROTEIN (MANNOSE 6 PHOSPHATE RECEPTOR BINDING PROTEIN) - Homo sapiens | 434 | 55/197 (27%) | 95/197 (48%) | 3.5e−10 |
| ptnr: SPTREMBL-ACC: Q9DBG5 | 1300012C15RIK PROTEIN (RIKEN CDNA 1300012C15 GENE) - Mus musculus | 437 | 46/145 (31%) | 75/145 (51%) | 2.4e−09 |

Other BLAST results include sequences from the Patp database, which is a proprietary database that contains sequences published in patents and patent publications. Patp results include those listed in Table 20F.

TABLE 20F

Patp BLASTP Analysis for NOV20

| Sequences producing High-scoring Segment Pairs | Protein/Organism | Length (aa) | Identity (%) | Positive (%) | E Value |
|---|---|---|---|---|---|
| patp: AAY48492 | Human breast tumour-associated protein 37 - Homo sapiens | 324 | 141/156 (90%) | 145/156 (92%) | 1.0e−68 |
| patp: AAY44929 | Human adipose differentiation associated protein-1 - Homo sapiens | 213 | 141/156 (90%) | 145/156 (92%) | 1.0e−68 |
| patp: AAY44930 | Human adipose differentiation associated protein-2 - Homo sapiens | 206 | 141/156 (90%) | 145/156 (92%) | 1.0e−68 |
| patp: AAY44931 | Mammalian adipose differentiation associated protein - Mammalia | 286 | 141/156 (90%) | 145/156 (92%) | 1.0e−68 |

TABLE 20F-continued

Patp BLASTP Analysis for NOV20

| Sequences producing High-scoring Segment Pairs | Protein/Organism | Length (aa) | Identity (%) | Positive (%) | E Value |
|---|---|---|---|---|---|
| patp: AAY67240 | Human adipophilin-like protein (HALP) amino acid sequence - Homo sapiens | 434 | 55/197 (27%) | 95/197 (48%) | 2.7e−10 |

Table 20G lists the domain description from DOMAIN analysis results against NOV20.

TABLE 20F

Domain Analysis of NOV20
Pfam analysis

| Model | Domain | seq-f | seq-t | hmm-f | hmm-t | score | E-value |
|---|---|---|---|---|---|---|---|
| [no hits above thresholds] | | | | | | | |

No significant domains were found.

The S3-12-like gene disclosed in this invention is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus, liver.

The sequence is predicted to be expressed in adipocytes because of the expression pattern of (GENBANK-ID: gb:GENBANK-ID:AF064748|acc:AF064748.1) a closely related *Mus musculus* S3-12 mRNA, complete cds homolog in species *Mus musculus*.

The nucleic acids and proteins of the invention have applications in the diagnosis and/or treatment of various diseases and disorders. For example, the compositions of the present invention may have efficacy for the treatment of patients suffering from obesity as well as other diseases, disorders and conditions. This novel human protein has best homology to a novel mouse protein S3-12 cloned from mouse adipocytes using an antibody based subtractive hybridization protocol. S3-12 contains tandem repeats of a threonine-rich 33-amino acid motif; which are similar to 33-amino acid motif in adipocyte differentiation-related protein (ADRP). Therefore the protein of this invention may be useful in the treatment of obesity and its complications, such as hypertension, diabetes.

This novel human protein has best homology to a novel mouse protein S3-12 cloned from mouse adipocytes using an antibody based subtractive hybridization protocol. It also contains tandem repeats of a threonine-rich 33-amino acid motif; which are similar to 33-amino acid motif in adipocyte differentiation-related protein (ADRP).

This sequence has 99% homology to a patented partial cDNA, Acc No A50242, that has been described as encoding an autoantigen diagnostic of endometriosis (see Y95851). These autoantigens (see Y95843-55) can be used in non-invasive assays to detect endometriosis. The assays are based on the binding of the autoantigens by autoantibodies in a body fluid of a patient. The autoantigens may be immobilized on solid supports and used in an immunoprecipitation assay, an enzyme linked immunosorbant assay (ELISA), a depletion enzyme-linked immunosorbant assay (dELISA), a Western blot, a particle agglutination assay, a luminescent oxygen-channeling immunoassay, a proximity-based immunosorbant assay and/or a biosensor-based immunoassay to detect the presence of autoantibodies immunospecific for them. The presence of such antibodies is indicative of the presence of endometriosis. High clinical sensitivity and specificity, as well as a means for assessing disease progression, prognosis and therapeutic efficacy, are achieved. Polynucleotides encoding the autoantigens can be used in the recombinant production of the autoantigens.

NOVX Nucleic Acids and Polypeptides

One aspect of the invention pertains to isolated nucleic acid molecules that encode NOVX polypeptides or biologically active portions thereof. Also included in the invention are nucleic acid fragments sufficient for use as hybridization probes to identify NOVX-encoding nucleic acids (e.g., NOVX mRNAs) and fragments for use as PCR primers for the amplification and/or mutation of NOVX nucleic acid molecules. As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule may be single-stranded or double-stranded, but preferably is comprised double-stranded DNA.

An NOVX nucleic acid can encode a mature NOVX polypeptide. As used herein, a "mature" form of a polypeptide or protein disclosed in the present invention is the product of a naturally occurring polypeptide or precursor form or proprotein. The naturally occurring polypeptide, precursor or proprotein includes, by way of nonlimiting example, the full-length gene product, encoded by the corresponding gene. Alternatively, it may be defined as the polypeptide, precursor or proprotein encoded by an ORF described herein. The product "mature" form arises, again by way of nonlimiting example, as a result of one or more naturally occurring processing steps as they may take place within the cell, or host cell, in which the gene product arises. Examples of such processing steps leading to a "mature" form of a polypeptide or protein include the cleavage of the N-terminal methionine residue encoded by the initiation codon of an ORF, or the proteolytic cleavage of a signal peptide or leader sequence. Thus a mature form arising from a precursor polypeptide or protein that has residues 1 to N, where residue 1 is the N-terminal methionine, would have residues 2 through N remaining after removal of the N-terminal methionine. Alternatively, a mature form arising from a precursor polypeptide or protein having residues 1 to N, in which an N-terminal signal sequence from residue 1 to residue M is cleaved, would have the residues from residue M+1 to residue N remaining. Further as used herein, a "mature" form of a polypeptide or protein may arise from a step of post-translational modification other than a proteolytic cleavage event. Such additional processes include, by way of non-limiting example, glycosylation, myristoylation or phosphorylation. In general, a mature polypeptide or protein may result from the operation of only one of these processes, or a combination of any of them.

The term "probes", as utilized herein, refers to nucleic acid sequences of variable length, preferably between at least about 10 nucleotides (nt), 100 nt, or as many as approximately, e.g., 6,000 nt, depending upon the specific use. Probes are used in the detection of identical, similar, or complementary nucleic acid sequences. Longer length probes are generally obtained from a natural or recombinant source, are highly specific, and much slower to hybridize than shorter-length oligomer probes. Probes may be single- or double-stranded and designed to have specificity in PCR, membrane-based hybridization technologies, or ELISA-like technologies.

The term "isolated" nucleic acid molecule, as utilized herein, is one, which is separated from other nucleic acid molecules which are present in the natural source of the nucleic acid. Preferably, an "isolated" nucleic acid is free of sequences which naturally flank the nucleic acid (i.e., sequences located at the 5'- and 3'-termini of the nucleic acid) in the genomic DNA of the organism from which the nucleic acid is derived. For example, in various embodiments, the isolated NOVX nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell/tissue from which the nucleic acid is derived (e.g., brain, heart, liver, spleen, etc.). Moreover, an "isolated" nucleic acid molecule, such as a cDNA molecule, can be substantially free of other cellular material or culture medium when produced by recombinant techniques, or of chemical precursors or other chemicals when chemically synthesized.

A nucleic acid molecule of the invention, e.g., a nucleic acid molecule having the nucleotide sequence SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or a complement of this aforementioned nucleotide sequence, can be isolated using standard molecular. biology techniques and the sequence information provided herein. Using all or a portion of the nucleic acid sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59 as a hybridization probe, NOVX molecules can be isolated using standard hybridization and cloning techniques (e.g., as described in Sambrook, et al., (eds.), MOLECULAR CLONING: A LABORATORY MANUAL $2^{nd}$ Ed., Cold Spring Harbor Laboratory Press, Cold Spring Harbor, N.Y., 1989; and Ausubel, et al., (eds.), CURRENT PROTOCOLS IN MOLECULAR BIOLOGY, John Wiley & Sons, New York, N.Y., 1993.)

A nucleic acid of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to NOVX nucleotide sequences can be prepared by standard synthetic techniques, e.g., using an automated DNA synthesizer.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides comprise portions of a nucleic acid sequence having about 10 nt, 50 nt, or 100 nt in length, preferably about 15 nt to 30 nt in length. In one embodiment of the invention, an oligonucleotide comprising a nucleic acid molecule less than 100 nt in length would further comprise at least 6 contiguous nucleotides SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or a complement thereof. Oligonucleotides may be chemically synthesized and may also be used as probes.

In another embodiment, an isolated nucleic acid molecule of the invention comprises a nucleic acid molecule that is a complement of the nucleotide sequence shown in SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or a portion of this nucleotide sequence (e.g., a fragment that can be used as a probe or primer or a fragment encoding a biologically-active portion of an NOVX polypeptide). A nucleic acid molecule that is complementary to the nucleotide sequence shown SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, or 59 is one that is sufficiently complementary to the nucleotide sequence shown SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, or 59 that it can hydrogen bond with little or no mismatches to the nucleotide sequence shown SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, or 59, thereby forming a stable duplex.

As used herein, the term "complementary" refers to Watson-Crick or Hoogsteen base pairing between nucleotides units of a nucleic acid molecule, and the term "binding" means the physical or chemical interaction between two polypeptides or compounds or associated polypeptides or compounds or combinations thereof. Binding includes ionic, non-ionic, van der Waals, hydrophobic interactions, and the like. A physical interaction can be either direct or indirect. Indirect interactions may be through or due to the effects of another polypeptide or compound. Direct binding refers to interactions that do not take place through, or due to, the effect of another polypeptide or compound, but instead are without other substantial chemical intermediates.

Fragments provided herein are defined as sequences of at least 6 (contiguous) nucleic acids or at least 4 (contiguous) amino acids, a length sufficient to allow for specific hybridization in the case of nucleic acids or for specific recognition of an epitope in the case of amino acids, respectively, and are at most some portion less than a full length sequence. Fragments may be derived from any contiguous portion of a nucleic acid or amino acid sequence of choice. Derivatives are nucleic acid sequences or amino acid sequences formed from the native compounds either directly or by modification or partial substitution. Analogs are nucleic acid sequences or amino acid sequences that have a structure similar to, but not identical to, the native compound but differs from it in respect to certain components or side chains. Analogs may be synthetic or from a different evolutionary origin and may have a similar or opposite metabolic activity compared to wild type. Homologs are nucleic acid sequences or amino acid sequences of a particular gene that are derived from different species.

Derivatives and analogs may be full length or other than full length, if the derivative or analog contains a modified nucleic acid or amino acid, as described below. Derivatives or analogs of the nucleic acids or proteins of the invention include, but are not limited to, molecules comprising regions that are substantially homologous to the nucleic acids or proteins of the invention, in various embodiments, by at least about 70%, 80%, or 95% identity (with a preferred identity of 80–95%) over a nucleic acid or amino acid sequence of identical size or when compared to an aligned sequence in which the alignment is done by a computer homology program known in the art, or whose encoding nucleic acid is capable of hybridizing to the complement of a sequence encoding the aforementioned proteins under stringent, moderately stringent, or low stringent conditions. See e.g. Ausubel, et al., CURRENT PROTOCOLS IN MOLECULAR BIOLOGY, John Wiley & Sons, New York, N.Y., 1993, and below.

A "homologous nucleic acid sequence" or "homologous amino acid sequence," or variations thereof, refer to sequences characterized by a homology at the nucleotide level or amino acid level as discussed above. Homologous nucleotide sequences encode those sequences coding for isoforms of NOVX polypeptides. Isoforms can be expressed in different tissues of the same organism as a result of, for example, alternative splicing of RNA. Alternatively, isoforms can be encoded by different genes. In the invention, homologous nucleotide sequences include nucleotide sequences encoding for an NOVX polypeptide of species other than humans, including, but not limited to: vertebrates, and thus can include, e.g., frog, mouse, rat, rabbit, dog, cat cow, horse, and other organisms. Homologous nucleotide sequences also include, but are not limited to, naturally occurring allelic variations and mutations of the nucleotide sequences set forth herein. A homologous nucleotide sequence does not, however, include the exact nucleotide sequence encoding human NOVX protein. Homologous nucleic acid sequences include those nucleic acid sequences that encode conservative amino acid substitutions (see below) in SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, as well as a polypeptide possessing NOVX biological activity. Various biological activities of the NOVX proteins are described below.

An NOVX polypeptide is encoded by the open reading frame ("ORF") of an NOVX nucleic acid. An ORF corresponds to a nucleotide sequence that could potentially be translated into a polypeptide. A stretch of nucleic acids comprising an ORF is uninterrupted by a stop codon. An ORF that represents the coding sequence for a full protein begins with an ATG "start" codon and terminates with one of the three "stop" codons, namely, TAA, TAG, or TGA. For the purposes of this invention, an ORF may be any part of a coding sequence, with or without a start codon, a stop codon, or both. For an ORF to be considered as a good candidate for coding for a bona fide cellular protein, a minimum size requirement is often set, e.g., a stretch of DNA that would encode a protein of 50 amino acids or more.

The nucleotide sequences determined from the cloning of the human NOVX genes allows for the generation of probes and primers designed for use in identifying and/or cloning NOVX homologues in other cell types, e.g. from other tissues, as well as NOVX homologues from other vertebrates. The probe/primer typically comprises substantially purified oligonucleotide. The oligonucleotide typically comprises a region of nucleotide sequence that hybridizes under stringent conditions to at least about 12, 25, 50, 100, 150, 200, 250, 300, 350 or 400 consecutive sense strand nucleotide sequence SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, or 59; or an anti-sense strand nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, or 59; or of a naturally occurring mutant of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59.

Probes based on the human NOVX nucleotide sequences can be used to detect transcripts or genomic sequences encoding the same or homologous proteins. In various embodiments, the probe further comprises a label group attached thereto, e.g. the label group can be a radioisotope, a fluorescent compound, an enzyme, or an enzyme co-factor. Such probes can be used as a part of a diagnostic test kit for identifying cells or tissues which mis-express an NOVX protein, such as by measuring a level of an NOVX-encoding nucleic acid in a sample of cells from a subject e.g., detecting NOVX mRNA levels or determining whether a genomic NOVX gene has been mutated or deleted.

"A polypeptide having a biologically-active portion of an NOVX polypeptide" refers to polypeptides exhibiting activity similar, but not necessarily identical to, an activity of a polypeptide of the invention, including mature forms, as measured in a particular biological assay, with or without dose dependency. A nucleic acid fragment encoding a "biologically-active portion of NOVX" can be prepared by isolating a portion SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, or 59, that encodes a polypeptide having an NOVX biological activity (the biological activities of the NOVX proteins are described below), expressing the encoded portion of NOVX protein (e.g., by recombinant expression in vitro) and assessing the activity of the encoded portion of NOVX.

NOVX Nucleic Acid and Polypeptide Variants

The invention further encompasses nucleic acid molecules that differ from the nucleotide sequences shown in SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59 due to degeneracy of the genetic code and thus encode the same NOVX proteins as that encoded by the nucleotide sequences shown in SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59. In another embodiment, an isolated nucleic acid molecule of the invention has a nucleotide sequence encoding a protein having an amino acid sequence shown in SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60.

In addition to the human NOVX nucleotide sequences shown in SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, it will be appreciated by those skilled in the art that DNA sequence polymorphisms that lead to changes in the amino acid sequences of the NOVX polypeptides may exist within a population (e.g., the human population). Such genetic polymorphism in the NOVX genes may exist among individuals within a population due to natural allelic variation. As used herein, the terms "gene" and "recombinant gene" refer to nucleic acid molecules comprising an open reading frame (ORF) encoding an NOVX protein, preferably a vertebrate NOVX protein. Such natural allelic variations can typically result in 1–5% variance in the nucleotide sequence of the NOVX genes. Any and all such nucleotide variations and resulting amino acid polymorphisms in the NOVX polypeptides, which are the result of natural allelic variation and that do not alter the functional activity of the NOVX polypeptides, are intended to be within the scope of the invention.

Moreover, nucleic acid molecules encoding NOVX proteins from other species, and thus that have a nucleotide sequence that differs from the human SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59 are intended to be within the scope of the invention. Nucleic acid molecules corresponding to natural allelic variants and homologues of the NOVX cDNAs of the invention can be isolated based on their homology to the human NOVX nucleic acids disclosed herein using the human cDNAs, or a portion thereof, as a hybridization probe according to standard hybridization techniques under stringent hybridization conditions.

Accordingly, in another embodiment, an isolated nucleic acid molecule of the invention is at least 6 nucleotides in length and hybridizes under stringent conditions to the nucleic acid molecule comprising the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59. In another embodiment, the nucleic acid is at least 10, 25, 50, 100, 250, 500, 750, 1000, 1500, or 2000 or more nucleotides in length. In yet another embodiment, an isolated nucleic acid molecule of the invention hybridizes to the coding region. As used herein, the term "hybridizes under stringent conditions" is intended to describe conditions for hybridization and washing under which nucleotide sequences at least 60% homologous to each other typically remain hybridized to each other.

Homologs (i.e., nucleic acids encoding NOVX proteins derived from species other than human) or other related sequences (e.g., paralogs) can be obtained by low, moderate or high stringency hybridization with all or a portion of the particular human sequence as a probe using methods well known in the art for nucleic acid hybridization and cloning.

As used herein, the phrase "stringent hybridization conditions" refers to conditions under which a probe, primer or oligonucleotide will hybridize to its target sequence, but to no other sequences. Stringent conditions are sequence-dependent and will be different in different circumstances. Longer sequences hybridize specifically at higher temperatures than shorter sequences. Generally, stringent conditions are selected to be about 5° C. lower than the thermal melting point (Tm) for the specific sequence at a defined ionic strength and pH. The Tm is the temperature (under defined ionic strength, pH and nucleic acid concentration) at which 50% of the probes complementary to the target sequence hybridize to the target sequence at equilibrium. Since the target sequences are generally present at excess, at Tm, 50% of the probes are occupied at equilibrium. Typically, stringent conditions will be those in which the salt concentration is less than about 1.0 M sodium ion, typically about 0.01 to 1.0 M sodium ion (or other salts) at pH 7.0 to 8.3 and the temperature is at least about 30° C. for short probes, primers or oligonucleotides (e.g., 10 nt to 50 nt) and at least about 60° C. for longer probes, primers and oligonucleotides. Stringent conditions may also be achieved with the addition of destabilizing agents, such as formamide.

Stringent conditions are known to those skilled in the art and can be found in Ausubel, et al., (eds.), CURRENT PROTOCOLS IN MOLECULAR BIOLOGY, John Wiley & Sons, N.Y. (1989), 6.3.1–6.3.6. Preferably, the conditions are such that sequences at least about 65%, 70%, 75%, 85%, 90%, 95%, 98%, or 99% homologous to each other typically remain hybridized to each other. A non-limiting example of stringent hybridization conditions are hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C., followed by one or more washes in 0.2×SSC, 0.01% BSA at 50° C. An isolated nucleic acid molecule of the invention that hybridizes under stringent conditions to the sequences SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In a second embodiment, a nucleic acid sequence that is hybridizable to the nucleic acid molecule comprising the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or fragments, analogs or derivatives thereof, under conditions of moderate stringency is provided. A non-limiting example of moderate stringency hybridization conditions are hybridization in 6×SSC, 5× Denhardt's solution, 0.5% SDS and 100 mg/ml denatured salmon sperm DNA at 55° C., followed by one or more washes in 1×SSC, 0.1% SDS at 37° C. Other conditions of moderate stringency that may be used are well-known within the art. See, e.g., Ausubel, et al. (eds.), 1993, CURRENT PROTOCOLS IN MOLECULAR BIOLOGY, John Wiley & Sons, NY, and Kriegler, 1990; GENE TRANSFER AND EXPRESSION, A LABORATORY MANUAL, Stockton Press, NY.

In a third embodiment, a nucleic acid that is hybridizable to the nucleic acid molecule comprising the nucleotide sequences SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or fragments, analogs or derivatives thereof, under conditions of low stringency, is provided. A non-limiting example of low stringency hybridization conditions are hybridization in 35% formamide, 5×SSC, 50 mM Tris-HCl (pH 7.5), 5 mM EDTA, 0.02% PVP, 0.02% Ficoll, 0.2% BSA, 100 mg/ml denatured salmon sperm DNA, 10% (wt/vol) dextran sulfate at 40° C., followed by one or more washes in 2×SSC, 25 mM Tris-HCl (pH 7.4), 5 mM EDTA, and 0.1% SDS at 50° C. Other conditions of low stringency that may be used are well known in the art (e.g., as employed for cross-species hybridizations). See, e.g. Ausubel, et al. (eds.), 1993, CURRENT PROTOCOLS IN MOLECULAR BIOLOGY, John Wiley & Sons, NY, and Kriegler, 1990, GENE TRANSFER AND EXPRESSION, A LABORATORY MANUAL, Stockton Press, NY; Shilo and Weinberg, 1981. *Proc Natl Acad Sci USA* 78: 6789–6792.

Conservative Mutations

In addition to naturally-occurring allelic variants of NOVX sequences that may exist in the population, the skilled artisan will further appreciate that changes can be introduced by mutation into the nucleotide sequences SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, thereby leading to changes in the amino acid sequences of the encoded NOVX proteins, without altering the functional ability of said NOVX proteins. For example, nucleotide substitutions leading to amino acid substitutions at "non-essential" amino acid residues can be made in the sequence SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60. A "non-essential" amino acid residue is a residue that can be altered from the wild-type sequences of the NOVX proteins without altering their biological activity, whereas an "essential" amino acid residue is required for such biological activity. For example, amino acid residues that are conserved among the NOVX proteins of the invention are predicted to be particularly non-amenable to alteration. Amino acids for which conservative substitutions can be made are well-known within the art.

Another aspect of the invention pertains to nucleic acid molecules encoding NOVX proteins that contain changes in amino acid residues that are not essential for activity. Such NOVX proteins differ in amino acid sequence from SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, and 60 yet retain biological activity. In one embodiment, the isolated nucleic acid molecule comprises a nucleotide sequence encoding a protein, wherein the protein comprises an amino acid sequence at least about 45% homologous to the amino acid sequences SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, and 60. Preferably, the protein encoded by the nucleic acid molecule is at least about 60% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 5.8, and 60; more preferably at least about 70% homologous SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60; still more preferably at least about 80% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60; even more preferably at least about 90% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60; and most preferably at least about 95% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60.

An isolated nucleic acid molecule encoding an NOVX protein homologous to the protein of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60 can be created by introducing one or more nucleotide substitutions, additions or deletions into the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, such that one or more amino acid substitutions, additions or deletions are introduced into the encoded protein. Mutations can be introduced into SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59 by standard techniques, such as site-directed mutagenesis and PCR-mediated mutagenesis. Preferably, conservative amino acid substitutions are made at one or more predicted, non-essential amino acid residues. A "conservative amino acid substitution" is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in the NOVX protein is replaced with another amino acid residue from the same side chain family. Alternatively, in another embodiment, mutations can be introduced randomly along all or part of an NOVX coding sequence, such as by saturation mutagenesis, and the resultant mutants can be screened for NOVX biological activity to identify mutants that retain activity. Following mutagenesis of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, the encoded protein can be expressed by any recombinant technology known in the art and the activity of the protein can be determined.

The relatedness of amino acid families may also be determined based on side chain interactions. Substituted amino acids may be fully conserved "strong" residues or fully conserved "weak" residues. The "strong" group of conserved amino acid residues may be any one of the following groups: STA, NEQK, NHQK, NDEQ, QHRK, MILV, MILF, HY, FYW, wherein the single letter amino acid codes are grouped by those amino acids that may be substituted for each other. Likewise, the "weak" group of conserved residues may be any one of the following: CSA, ATV, SAG, STNK, STPA, SGND, SNDEQK, NDEQHK, NEQHRK, VLIM, HFY, wherein the letters within each group represent the single letter amino acid code.

In one embodiment, a mutant NOVX protein can be assayed for (i) the ability to form protein:protein interactions with other NOVX proteins, other cell-surface proteins, or biologically-active portions thereof, (ii) complex formation between a mutant NOVX protein and an NOVX ligand; or (iii) the ability of a mutant NOVX protein to bind to an intracellular target protein or biologically-active portion thereof; (e.g. avidin proteins).

In yet another embodiment, a mutant NOVX protein can be assayed for the ability to regulate a specific biological function (e.g., regulation of insulin release).

Antisense Nucleic Acids

Another aspect of the invention pertains to isolated antisense nucleic acid molecules that are hybridizable to or complementary to the nucleic acid molecule comprising the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or fragments, analogs or derivatives thereof. An "antisense" nucleic acid comprises a nucleotide sequence that is complementary to a "sense" nucleic acid encoding a protein (e.g., complementary to the coding strand of a double-stranded cDNA molecule or complementary to an mRNA sequence). In specific aspects, antisense nucleic acid molecules are provided that comprise a sequence complementary to at least about 10, 25, 50, 100, 250 or 500 nucleotides or an entire NOVX coding strand, or to only a portion thereof. Nucleic acid molecules encoding fragments, homologs, derivatives and analogs of an NOVX protein of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60, or antisense nucleic acids complementary to an NOVX nucleic acid sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, are additionally provided.

In one embodiment, an antisense nucleic acid molecule is antisense to a "coding region" of the coding strand of a nucleotide sequence encoding an NOVX protein. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding the NOVX protein. The term "noncoding region" refers to 5' and 3' sequences which flank the coding region that are not translated into amino acids (i.e., also referred to as 5' and 3' untranslated regions).

Given the coding strand sequences encoding the NOVX protein disclosed herein, antisense nucleic acids of the invention can be designed according to the rules of Watson and Crick or Hoogsteen base pairing. The antisense nucleic acid molecule can be complementary to the entire coding region of NOVX mRNA, but more preferably is an oligonucleotide that is antisense to only a portion of the coding or noncoding region of NOVX mRNA. For example, the antisense oligonucleotide can be complementary to the region surrounding the translation start site of NOVX mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally-occurring nucleotides or variously modified nucleotides designed to increase the biological stability of the molecules or to increase the physical stability of the duplex formed between the antisense and sense nucleic acids (e.g., phosphorothioate derivatives and acridine substituted nucleotides can be used).

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding an NOVX protein to thereby inhibit expression of the protein (e.g., by inhibiting transcription and/or translation). The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface (e.g., by linking the antisense nucleic acid molecules to peptides or antibodies that bind to cell surface receptors or antigens). The antisense nucleic acid molecules can also be delivered to cells using the vectors described herein. To achieve sufficient nucleic acid molecules, vector constructs in which the antisense nucleic acid molecule is placed under the control of a strong pol II or pol III promoter are preferred.

In yet another embodiment, the antisense nucleic acid molecule of the invention is an □-anomeric nucleic acid molecule. An □-anomeric nucleic acid molecule forms specific double-stranded hybrids with complementary RNA in which, contrary to the usual □-units, the strands run parallel to each other. See, e.g., Gaultier, et al., 1987. *Nucl. Acids Res.* 15: 6625–6641. The antisense nucleic acid molecule can also comprise a 2'-α-methylribonucleotide (See, e.g., Inoue, et al. 1987. *Nucl. Acids Res.* 15: 6131–6148) or a chimeric RNA-DNA analogue (See, e.g., Inoue, et al., 1987. *FEBS Lett.* 215: 327–330.

Ribozymes and PNA Moieties

Nucleic acid modifications include, by way of non-limiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

In one embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes as described in Haselhoff and Gerlach 1988. *Nature* 334: 585–591) can be used to catalytically cleave NOVX mRNA transcripts to thereby inhibit translation of NOVX mRNA. A ribozyme having specificity for an NOVX-encoding nucleic acid can be designed based upon the nucleotide sequence of an NOVX cDNA disclosed herein (i.e., SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59). For example, a derivative of a Tetrahymena L-19 IVS RNA can be constructed in which the nucleotide sequence of the active site is complementary to the nucleotide sequence to be cleaved in an NOVX-encoding mRNA. See, e.g., U.S. Pat. No. 4,987,071 to Cech, et al. and U.S. Pat. No. 5,116,742 to Cech, et al. NOVX mRNA can also be used to select a catalytic RNA having a specific ribonuclease activity from a pool of RNA molecules. See, e.g., Bartel et al., (1993) *Science* 261:1411–1418.

Alternatively, NOVX gene expression can be inhibited by targeting nucleotide sequences complementary to the regulatory region of the NOVX nucleic acid (e.g., the NOVX promoter and/or enhancers) to form triple helical structures that prevent transcription of the NOVX gene in target cells. See, e.g., Helene, 1991. *Anticancer Drug Des.* 6: 569–84; Helene, et al. 1992. *Ann. N.Y. Acad. Sci.* 660: 27–36; Maher, 1992. *Bioassays* 14: 807–15.

In various embodiments, the NOVX nucleic acids can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids. See, e.g., Hyrup, et al., 1996. *Bioorg Med Chem* 4: 5–23. As used herein, the terms "peptide nucleic acids" or "PNAs" refer to nucleic acid mimics (e.g., DNA mimics) in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup, et al., 1996. supra; Perry-O'Keefe, et al., 1996. *Proc. Natl. Acad. Sci. USA* 93: 14670–14675.

PNAs of NOVX can be used in therapeutic and diagnostic applications. For example, PNAs can be used as antisense or antigene agents for sequence-specific modulation of gene expression by, e.g., inducing transcription or translation arrest or inhibiting replication. PNAs of NOVX can also be used, for example, in the analysis of single base pair mutations in a gene (e.g., PNA directed PCR clamping; as artificial restriction enzymes when used in combination with other enzymes, e.g., $S_1$ nucleases (See, Hyrup, et al., 1996.supra); or as probes or primers for DNA sequence and hybridization (See, Hyrup, et al., 1996, supra; Perry-O'Keefe, et al., 1996. supra).

In another embodiment, PNAs of NOVX can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras of NOVX can be generated that may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (see, Hyrup, et al., 1996. supra). The synthesis of PNA-DNA chimeras can be performed as described in Hyrup, et al., 1996. supra and Finn, et al., 1996. *Nucl Acids Res* 24: 3357–3363. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA. See, e.g., Mag, et al., 1989. *Nucl Acid Res* 17: 5973–5988. PNA monomers are then coupled in a stepwise manner to produce a chimeric molecule with a 5' PNA segment and a 3' DNA segment. See, e.g., Finn, et al., 1996. supra. Alternatively, chimeric molecules can be synthesized with a 5' DNA segment and a 3' PNA segment. See, e.g., Petersen, et al., 1975. *Bioorg. Med. Chem. Lett.* 5: 1119–11124.

In other embodiments, the oligonucleotide may include other appended groups such as peptides (e.g., for targeting host cell receptors in vivo), or agents facilitating transport across the cell membrane (see, e.g., Letsinger, et al., 1989. *Proc. Natl. Acad. Sci. USA.* 86: 6553–6556; Lemaitre, et al., 1987. *Proc. Natl. Acad. Sci.* 84: 648–652; PCT Publication No. WO88/09810) or the blood-brain barrier (see, e.g., PCT Publication No. WO 89/10134). In addition, oligonucleotides can be modified with hybridization triggered cleavage agents (see, e.g., Krol, et al., 1988. *BioTechniques* 6:958–976) or intercalating agents (see, e.g., Zon, 1988. *Pharm. Res.* 5: 539–549). To this end, the oligonucleotide may be conjugated to another molecule, e.g., a peptide, a hybridization triggered cross-linking agent, a transport agent, a hybridization-triggered cleavage agent, and the like.

NOVX Polypeptides

A polypeptide according to the invention includes a polypeptide including the amino acid sequence of NOVX polypeptides whose sequences are provided in SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60. The invention also includes a mutant or variant protein any of whose residues may be changed from the corresponding residues shown in SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60 while still encoding a protein that maintains its NOVX activities and physiological functions, or a functional fragment thereof.

In general, an NOVX variant that preserves NOVX-like function includes any variant in which residues at a particular position in the sequence have been substituted by other amino acids, and further include the possibility of inserting an additional residue or residues between two residues of the parent protein as well as the possibility of deleting one or more residues from the parent sequence. Any amino acid substitution, insertion, or deletion is encompassed by the invention. In favorable circumstances, the substitution is a conservative substitution as defined above.

One aspect of the invention pertains to isolated NOVX proteins, and biologically-active portions thereof, or derivatives, fragments, analogs or homologs thereof. Also provided are polypeptide fragments suitable for use as immunogens to raise anti-NOVX antibodies. In one embodiment, native NOVX proteins can be isolated from cells or tissue sources by an appropriate purification scheme using standard protein purification techniques. In another embodiment, NOVX proteins are produced by recombinant DNA techniques. Alternative to recombinant expression, an NOVX protein or polypeptide can be synthesized chemically using standard peptide synthesis techniques.

An "isolated" or "purified" polypeptide or protein or biologically-active portion thereof is substantially free of cellular material or other contaminating proteins from the cell or tissue source from which the NOVX protein is derived, or substantially free from chemical precursors or other chemicals when chemically synthesized. The language "substantially free of cellular material" includes preparations of NOVX proteins in which the protein is separated from cellular components of the cells from which it is isolated or recombinantly-produced. In one embodiment, the language "substantially free of cellular material" includes preparations of NOVX proteins having less than about 30% (by dry weight) of non-NOVX proteins (also referred to herein as a "contaminating protein"), more preferably less than about 20% of non-NOVX proteins, still more preferably less than about 10% of non-NOVX proteins, and most preferably less than about 5% of non-NOVX proteins. When the NOVX protein or biologically-active portion thereof is recombinantly-produced, it is also preferably substantially free of culture medium, i.e., culture medium represents less than about 20%, more preferably less than about 10%, and most preferably less than about 5% of the volume of the NOVX protein preparation.

The language "substantially free of chemical precursors or other chemicals" includes preparations of NOVX proteins in which the protein is separated from chemical precursors or other chemicals that are involved in the synthesis of the protein. In one embodiment, the language "substantially free of chemical precursors or other chemicals" includes preparations of NOVX proteins having less than about 30% (by dry weight) of chemical precursors or non-NOVX chemicals, more preferably less than about 20% chemical precursors or non-NOVX chemicals, still more preferably less than about 10% chemical precursors or non-NOVX chemicals, and most preferably less than about 5% chemical precursors or non-NOVX chemicals.

Biologically-active portions of NOVX proteins include peptides comprising amino acid sequences sufficiently homologous to or derived from the amino acid sequences of the NOVX proteins (e.g., the amino acid sequence shown in SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60) that include fewer amino acids than the full-length NOVX proteins, and exhibit at least one activity of an NOVX protein. Typically, biologically-active portions comprise a domain or motif with at least one activity of the NOVX protein. A biologically-active portion of an NOVX protein can be a polypeptide which is, for example, 10, 25, 50, 100 or more amino acid residues in length. Moreover, other biologically-active portions, in which other regions of the protein are deleted, can be prepared by recombinant techniques and evaluated for one or more of the functional activities of a native NOVX protein.

In an embodiment, the NOVX protein has an amino acid sequence shown SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60. In other embodiments, the NOVX protein is substantially homologous to SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60, and retains the functional activity of the protein of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60, yet differs in amino acid sequence due to natural allelic variation or mutagenesis, as described in detail, below.

Accordingly, in another embodiment, the NOVX protein is a protein that comprises an amino acid sequence at least about 45% homologous to the amino acid sequence SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60, and retains the functional activity of the NOVX proteins of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60.

Determining Homology Between Two or More Sequences

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are homologous at that position (i.e., as used herein amino acid or nucleic acid "homology" is equivalent to amino acid or nucleic acid "identity").

The nucleic acid sequence homology may be determined as the degree of identity between two sequences. The homology may be determined using computer programs known in the art, such as GAP software provided in the GCG program package. See, Needleman and Wunsch, 1970. *J Mol Biol* 48: 443–453. Using GCG GAP software with the following settings for nucleic acid sequence comparison: GAP creation penalty of 5.0 and GAP extension penalty of 0.3, the coding region of the analogous nucleic acid sequences referred to above exhibits a degree of identity preferably of at least 70%, 75%, 80%, 85%, 90%, 95%, 98%, or 99%, with the CDS (encoding) part of the DNA sequence shown in SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59.

The term "sequence identity" refers to the degree to which two polynucleotide or polypeptide sequences are identical on a residue-by-residue basis over a particular region of comparison. The term "percentage of sequence identity" is calculated by comparing two optimally aligned sequences over that region of comparison, determining the number of positions at which the identical nucleic acid base (e.g., A, T, C, G, U, or I, in the case of nucleic acids) occurs in both sequences to yield the number of matched positions, dividing the number of matched positions by the total number of positions in the region of comparison (i.e., the window size), and multiplying the result by 100 to yield the percentage of sequence identity. The term "substantial identity" as used herein denotes a characteristic of a polynucleotide sequence, wherein the polynucleotide comprises a sequence that has at least 80 percent sequence identity, preferably at least 85 percent identity and often 90 to 95 percent sequence identity, more usually at least 99 percent sequence identity as compared to a reference sequence over a comparison region.

Chimeric and Fusion Proteins

The invention also provides NOVX chimeric or fusion proteins. As used herein, an NOVX "chimeric protein" or "fusion protein" comprises an NOVX polypeptide operatively-linked to a non-NOVX polypeptide. An "NOVX polypeptide" refers to a polypeptide having an amino acid sequence corresponding to an NOVX protein SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, or 60), whereas a "non-NOVX polypeptide" refers to a polypeptide having an amino acid sequence corresponding to a protein that is not substantially homologous to the NOVX protein, e.g., a protein that is different from the NOVX protein and that is derived from the same or a different organism. Within an NOVX fusion protein the NOVX polypeptide can correspond to all or a portion of an NOVX protein. In one embodiment, an NOVX fusion protein comprises at least one biologically-active portion of an NOVX protein. In another embodiment, an NOVX fusion protein comprises at least two biologically-active portions of an NOVX protein. In yet another embodiment, an NOVX fusion protein comprises at least three biologically-active portions of an NOVX protein. Within the fusion protein, the term "operatively-linked" is intended to indicate that the NOVX polypeptide and the non-NOVX polypeptide are fused in-frame with one another. The non-NOVX polypeptide can be fused to the N-terminus or C-terminus of the NOVX polypeptide.

In one embodiment, the fusion protein is a GST-NOVX fusion protein in which the NOVX sequences are fused to the C-terminus of the GST (glutathione S-transferase) sequences. Such fusion proteins can facilitate the purification of recombinant NOVX polypeptides.

In another embodiment, the fusion protein is an NOVX protein containing a heterologous signal sequence at its N-terminus. In certain host cells (e.g., mammalian host cells), expression and/or secretion of NOVX can be increased through use of a heterologous signal sequence.

In yet another embodiment, the fusion protein is an NOVX-immunoglobulin fusion protein in which the NOVX sequences are fused to sequences derived from a member of the immunoglobulin protein family. The NOVX-immunoglobulin fusion proteins of the invention can be incorporated into pharmaceutical compositions and administered to a subject to inhibit an interaction between an NOVX ligand and an NOVX protein on the surface of a cell, to thereby suppress NOVX-mediated signal transduction in vivo. The NOVX-immunoglobulin fusion proteins can be used to affect the bioavailability of an NOVX cognate ligand. Inhibition of the NOVX ligand/NOVX interaction may be useful therapeutically for both the treatment of proliferative and differentiative disorders, as well as modulating (e.g. promoting or inhibiting) cell survival. Moreover, the NOVX-immunoglobulin fusion proteins of the invention can be used as immunogens to produce anti-NOVX antibodies in a subject, to purify NOVX ligands, and in screening assays to identify molecules that inhibit the interaction of NOVX with an NOVX ligand.

An NOVX chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel, et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). An NOVX-encoding nucleic acid can be cloned into such an expression vector such that the fusion moiety is linked in-frame to the NOVX protein.

NOVX Agonists and Antagonists

The invention also pertains to variants of the NOVX proteins that function as either NOVX agonists (i.e., mimetics) or as NOVX antagonists. Variants of the NOVX protein can be generated by mutagenesis (e.g., discrete point mutation or truncation of the NOVX protein). An agonist of the NOVX protein can retain substantially the same, or a subset of, the biological activities of the naturally occurring form of the NOVX protein. An antagonist of the NOVX protein can inhibit one or more of the activities of the naturally occurring form of the NOVX protein by, for example, competitively binding to a downstream or upstream member of a cellular signaling cascade which includes the NOVX protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the NOVX proteins.

Variants of the NOVX proteins that function as either NOVX agonists (i.e., mimetics) or as NOVX antagonists can be identified by screening combinatorial libraries of mutants (e.g., truncation mutants) of the NOVX proteins for NOVX protein agonist or antagonist activity. In one embodiment, a variegated library of NOVX variants is generated by combinatorial mutagenesis at the nucleic acid level and is encoded by a variegated gene library. A variegated library of NOVX variants can be produced by, for example, enzymatically ligating a mixture of synthetic oligonucleotides into gene sequences such that a degenerate set of potential NOVX sequences is expressible as individual polypeptides, or alternatively, as a set of larger fusion proteins (e.g., for phage display) containing the set of NOVX sequences therein. There are a variety of methods which can be used to produce libraries of potential NOVX variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential NOVX sequences. Methods for synthesizing degenerate oligonucleotides are well-known within the art. See, e.g., Narang, 1983. *Tetrahedron* 39: 3; Itakura, et al., 1984. *Annu. Rev. Biochem.* 53: 323; Itakura, et al., 1984. *Science* 198: 1056; Ike, et al., 1983. *Nucl. Acids Res.* 11: 477.

Polypeptide Libraries

In addition, libraries of fragments of the NOVX protein coding sequences can be used to generate a variegated population of NOVX fragments for screening and subsequent selection of variants of an NOVX protein. In one embodiment, a library of coding sequence fragments can be generated by treating a double stranded PCR fragment of an NOVX coding sequence with a nuclease under conditions wherein nicking occurs only about once per molecule, denaturing the double stranded DNA, renaturing the DNA to form double-stranded DNA that can include sense/antisense pairs from different nicked products, removing single stranded portions from reformed duplexes by treatment with $S_1$ nuclease, and ligating the resulting fragment library into an expression vector. By this method, expression libraries can be derived which encodes N-terminal and internal fragments of various sizes of the NOVX proteins.

Various techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of NOVX proteins. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify NOVX variants. See, e.g., Arkin and Yourvan, 1992. *Proc. Natl. Acad. Sci. USA* 89: 7811–7815; Delgrave, et al., 1993. *Protein Engineering* 6:327–331.

Anti-NOVX Antibodies

Also included in the invention are antibodies to NOVX proteins, or fragments of NOVX proteins. The term "antibody" as used herein refers to immunoglobulin molecules and immunologically active portions of immunoglobulin (Ig) molecules, i.e., molecules that contain an antigen binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, an antibody molecule obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated NOVX-related protein of the invention may be intended to serve as an antigen, or a portion or fragment thereof, and additionally can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the antigenic peptide is a region of NOVX-related protein that is located on the surface of the protein, e.g., a hydrophilic region. A hydrophobicity analysis of the human NOVX-related protein sequence will indicate which regions of a NOVX-related protein are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each of which is incorporated herein by reference in its entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow and Lane, 1988, Cold Spring Harbor Laboratory Press, Cold Spring Harbor, N.Y., incorporated herein by reference). Some of these antibodies are discussed below.

Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), adjuvants usable in humans such as Bacille Calmette-Guerin and *Corynebacterium parvum*, or similar immunostimulatory agents. Additional examples of adjuvants which can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen binding site capable of immunoreacting with a particular epitope of the antigen characterized by a unique binding affinity for it.

Monoclonal antibodies can be prepared using hybridoma methods, such as those described by Kohler and Milstein, *Nature,* 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, MONOCLONAL ANTIBODIES: PRINCIPLES AND PRACTICE, Academic Press, (1986) pp. 59–103). Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies (Kozbor, *J. Immunol.,* 133:3001 (1984); Brodeur et al., MONOCLONAL ANTIBODY PRODUCTION TECHNIQUES AND APPLICATIONS, Marcel Dekker, Inc., New York, (1987) pp. 51–63).

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.,* 107:220 (1980). Preferably, antibodies having a high degree of specificity and a high binding affinity for the target antigen are isolated.

After the desired hybridoma cells are identified, the clones can be subcloned by limiting dilution procedures and grown by standard methods. Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, Nature 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., Nature, 321:522–525 (1986); Riechmann et al., Nature, 332:323–327 (1988); Verhoeyen et al., Science, 239:1534–1536 (1988)), by substituting rodent CDRs or CDR sequences for the corresponding sequences of a human antibody. (See also U.S. Pat. No. 5,225,539.) In some instances, Fv framework residues of the human immunoglobulin are replaced by corresponding non-human residues. Humanized antibodies can also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, Curr. Op. Struct. Biol., 2:593–596 (1992)).

Human Antibodies

Fully human antibodies relate to antibody molecules in which essentially the entire sequences of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. Proc Natl Acad Sci USA 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, J. Mol. Biol., 227:381 (1991); Marks et al., J. Mol. Biol., 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in Marks et al. (Bio/Technology 10, 779–783 (1992)); Lonberg et al. (Nature 368 856–859 (1994)); Morrison (Nature 368, 812–13 (1994)); Fishwild et al, (Nature Biotechnology 14, 845–51 (1996)); Neuberger (Nature Biotechnology 14, 826 (1996)); and Lonberg and Huszar (Intern. Rev. Immunol. 13 65–93 (1995)).

Human antibodies may additionally be produced using transgenic nonhuman animals which are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells which secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

$F_{ab}$ Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of Fab expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an Fab fragment generated by the treatment of the antibody molecule with papain and a reducing agent and (iv) $F_v$ fragments.

Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit. Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, Nature, 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., 1991 EMBO J., 10:3655–3659.

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., Methods in Enzymology, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., Science 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from E. coli and chemically coupled to form bispecific antibodies. Shalaby et al., J. Exp. Med. 175:217–225 (1992) describe the production of a fully humanized bispecific antibody F(ab')$_2$ molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., J. Immunol. 148(5):1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., J. Exp Med., 176: 1191–1195 (1992) and Shopes, J. Immunol., 148: 2918–2922 (1992). Homodimeric antibodies with enhanced anti-tumor activity can also be prepared using heterobifunctional cross-linkers as described in Wolff et al. Cancer Research, 53: 2560–2565 (1993). Alternatively, an antibody can be engineered that has dual Fc regions and can thereby have enhanced complement lysis and ADCC capabilities. See Stevenson et al., Anti-Cancer Drug Design, 3: 219–230 (1989).

Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *momordica charantia* inhibitor, curcin, crotin, *sapaonaria officinalis* inhibitor, gelonin, mitogellin, restrictocin, phenomycin, enomycin, and the tricothecenes. A variety of radionuclides are available for the production of radioconjugated antibodies. Examples include $^{212}Bi$, $^{131}I$, $^{131}In$, $^{90}Y$, and $^{86}Re$.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

In one embodiment, methods for the screening of antibodies that possess the desired specificity include, but are not limited to, enzyme-linked immunosorbent assay (ELISA) and other immunologically-mediated techniques known within the art. In a specific embodiment, selection of antibodies that are specific to a particular domain of an NOVX protein is facilitated by generation of hybridomas that bind to the fragment of an NOVX protein possessing such a domain. Thus, antibodies that are specific for a desired domain within an NOVX protein, or derivatives, fragments, analogs or homologs thereof, are also provided herein.

Anti-NOVX antibodies may be used in methods known within the art relating to the localization and/or quantitation of an NOVX protein (e.g., for use in measuring levels of the NOVX protein within appropriate physiological samples, for use in diagnostic methods, for use in imaging the protein, and the like). In a given embodiment, antibodies for NOVX proteins, or derivatives, fragments, analogs or homologs thereof, that contain the antibody derived binding domain, are utilized as pharmacologically-active compounds (hereinafter "Therapeutics").

An anti-NOVX antibody (e.g., monoclonal antibody) can be used to isolate an NOVX polypeptide by standard techniques, such as affinity chromatography or immunoprecipitation. An anti-NOVX antibody can facilitate the purification of natural NOVX polypeptide from cells and of recombinantly-produced NOVX polypeptide expressed in host cells. Moreover, an anti-NOVX antibody can be used to detect NOVX protein (e.g., in a cellular lysate or cell supernatant) in order to evaluate the abundance and pattern of expression of the NOVX protein. Anti-NOVX antibodies can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, □-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or 3H.

NOVX Recombinant Expression Vectors and Host Cells

Another aspect of the invention pertains to vectors, preferably expression vectors, containing a nucleic acid encoding an NOVX protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell).

The term "regulatory sequence" is intended to includes promoters, enhancers and other expression control elements (e.g., polyadenylation signals). Such regulatory sequences are described, for example, in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., NOVX proteins, mutant forms of NOVX proteins, fusion proteins, etc.).

The recombinant expression vectors of the invention can be designed for expression of NOVX proteins in prokaryotic or eukaryotic cells. For example, NOVX proteins can be expressed in bacterial cells such as *Escherichia coli*, insect cells (using baculovirus expression vectors) yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988. Gene 67: 31–40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) Gene 69:301–315) and pET 11d (Studier et al., GENE EXPRESSION TECHNOLOGY: METHODS IN ENZYMOLOGY 185, Academic Press, San Diego, Calif. (1990) 60–89).

One strategy to maximize recombinant protein expression in *E. coli* is to express the protein in a host bacteria with an impaired capacity to proteolytically cleave the recombinant protein. See, e.g., Gottesman, GENE EXPRESSION TECHNOLOGY: METHODS IN ENZYMOLOGY 185, Academic Press, San Diego, Calif. (1990) 119–128. Another strategy is to alter the nucleic acid sequence of the nucleic acid to be inserted into an expression vector so that the individual codons for each amino acid are those preferentially utilized in *E. coli* (see, e.g., Wada, et al., 1992. *Nucl. Acids Res.* 20: 2111–2118). Such alteration of nucleic acid sequences of the invention can be carried out by standard DNA synthesis techniques.

In another embodiment, the NOVX expression vector is a yeast expression vector. Examples of vectors for expression in yeast *Saccharomyces cerivisae* include pYepSec1 (Baldari, et al., 1987. *EMBO J.* 6: 229–234), pMFa (Kurjan and Herskowitz, 1982. *Cell* 30: 933–943), pJRY88 (Schultz et al., 1987. *Gene* 54: 113–123), pYES2 (Invitrogen Corporation, San Diego, Calif.), and picZ (InVitrogen Corp, San Diego, Calif.).

Alternatively, NOVX can be expressed in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156–2165) and the pVL series (Lucklow and Summers, 1989. *Virology* 170: 31–39).

In yet another embodiment, a nucleic acid of the invention is expressed in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187–195). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268–277), lymphoid-specific promoters (Calame and Eaton, 1988. *Adv. Immunol.* 43: 235–275), in particular promoters of T cell receptors (Winoto and Baltimore, 1989. *EMBO J.* 8: 729–733) and immunoglobulins (Banerji, et al., 1983. *Cell* 33: 729–740; Queen and Baltimore, 1983. *Cell* 33: 741–748), neuron-specific promoters (e.g., the neurofilament promoter; Byrne and Ruddle, 1989. *Proc. Natl. Acad. Sci. USA* 86: 5473–5477), pancreas-specific promoters (Edlund, et al., 1985. *Science* 230: 912–916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374–379) and the $\Box$-fetoprotein promoter (Campes and Tilghman, 1989. *Genes Dev.* 3: 537–546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to NOVX mRNA. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et al., "Antisense RNA as a molecular tool for genetic analysis," *Reviews-Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, NOVX protein can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding NOVX or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) NOVX protein. Accordingly, the invention further provides methods for producing NOVX protein using the host cells of the invention. In one embodiment, the method comprises culturing the host cell of invention (into which a recombinant expression vector encoding NOVX protein has been introduced) in a suitable medium such that NOVX protein is produced. In another embodiment, the method further comprises isolating NOVX protein from the medium or the host cell.

Transgenic NOVX Animals

The host cells of the invention can also be used to produce non-human transgenic animals. For example, in one embodiment, a host cell of the invention is a fertilized oocyte or an embryonic stem cell into which NOVX protein-coding sequences have been introduced. Such host cells can then be used to create non-human transgenic animals in which exogenous NOVX sequences have been introduced into their genome or homologous recombinant animals in which endogenous NOVX sequences have been altered. Such animals are useful for studying the function and/or activity of NOVX protein and for identifying and/or evaluating modulators of NOVX protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA that is integrated into the genome of a cell from which a transgenic animal develops and that remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous NOVX gene has been altered by homologous recombination between the endogenous gene and an exogenous DNA molecule introduced into a cell of the animal, e.g., an embryonic cell of the animal, prior to development of the animal.

A transgenic animal of the invention can be created by introducing NOVX-encoding nucleic acid into the male pronuclei of a fertilized oocyte (e.g., by microinjection, retroviral infection) and allowing the oocyte to develop in a pseudopregnant female foster animal. The human NOVX cDNA sequences SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59 can be introduced as a transgene into the genome of a non-human animal. Alternatively, a non-human homologue of the human NOVX gene, such as a mouse NOVX gene, can be isolated based on hybridization to the human NOVX cDNA (described further supra) and used as a transgene. Intronic sequences and polyadenylation signals can also be included in the transgene to increase the efficiency of expression of the transgene. A tissue-specific regulatory sequence(s) can be operably-linked to the NOVX transgene to direct expression of NOVX protein to particular cells. Methods for generating transgenic animals via embryo manipulation and microinjection, particularly animals such as mice, have become conventional in the art and are described, for example, in U.S. Pat. Nos. 4,736,866; 4,870, 009; and 4,873,191; and Hogan, 1986. In: MANIPULATING THE MOUSE EMBRYO, Cold Spring Harbor Laboratory Press, Cold Spring Harbor, N.Y. Similar methods are used for production of other transgenic animals. A transgenic founder animal can be identified based upon the presence of the NOVX transgene in its genome and/or expression of NOVX mRNA in tissues or cells of the animals. A transgenic founder animal can then be used to breed additional animals carrying the transgene. Moreover, transgenic animals carrying a transgene-encoding NOVX protein can further be bred to other transgenic animals carrying other transgenes.

To create a homologous recombinant animal, a vector is prepared which contains at least a portion of an NOVX gene into which a deletion, addition or substitution has been introduced to thereby alter, e.g., functionally disrupt, the NOVX gene. The NOVX gene can be a human gene (e.g., the cDNA of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59), but more preferably, is a non-human homologue of a human NOVX gene. For example, a mouse homologue of human NOVX gene of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59 can be used to construct a homologous recombination vector suitable for altering an endogenous NOVX gene in the mouse genome. In one embodiment, the vector is designed such that, upon homologous recombination, the endogenous NOVX gene is functionally disrupted (i.e., no longer encodes a functional protein; also referred to as a "knock out" vector).

Alternatively, the vector can be designed such that, upon homologous recombination, the endogenous NOVX gene is mutated or otherwise altered but still encodes functional protein (e.g., the upstream regulatory region can be altered to thereby alter the expression of the endogenous NOVX protein). In the homologous recombination vector, the altered portion of the NOVX gene is flanked at its 5'- and 3'-termini by additional nucleic acid of the NOVX gene to allow for homologous recombination to occur between the exogenous NOVX gene carried by the vector and an endogenous NOVX gene in an embryonic stem cell. The additional flanking NOVX nucleic acid is of sufficient length for successful homologous recombination with the endogenous gene. Typically, several kilobases of flanking DNA (both at the 5'- and 3'-termini) are included in the vector. See, e.g., Thomas, et al., 1987. *Cell* 51: 503 for a description of homologous recombination vectors. The vector is ten introduced into an embryonic stem cell line (e.g., by electroporation) and cells in which the introduced NOVX gene has homologously-recombined with the endogenous NOVX gene are selected. See, e.g., Li, et al., 1992. *Cell* 69: 915.

The selected cells are then injected into a blastocyst of an animal (e.g., a mouse) to form aggregation chimeras. See, e.g., Bradley, 1987. In: TERATOCARCINOMAS AND EMBRYONIC STEM CELLS: A PRACTICAL APPROACH, Robertson, ed. IRL, Oxford, pp. 113–152. A chimeric embryo can then be implanted into a suitable pseudopregnant female foster animal and the embryo brought to term. Progeny harboring the homologously-recombined DNA in their germ cells can be used to breed animals in which all cells of the animal contain the homologously-recombined DNA by germline transmission of the transgene. Methods for constructing homologous recombination vectors and homologous recombinant animals are described further in Bradley, 1991. *Curr. Opin. Biotechnol.* 2: 823–829; PCT International Publication Nos.: WO 90/11354; WO 91/01140; WO 92/0968; and WO 93/04169.

In another embodiment, transgenic non-humans animals can be produced that contain selected systems that allow for regulated expression of the transgene. One example of such a system is the cre/loxP recombinase system of bacteriophage P1. For a description of the cre/loxP recombinase system, See, e.g., Lakso, et al., 1992. *Proc. Natl. Acad. Sci. USA* 89: 6232–6236. Another example of a recombinase system is the FLP recombinase system of *Saccharomyces cerevisiae*. See, O'Gorman, et al., 1991. *Science* 251:1351–1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, et al., 1997. *Nature* 385: 810–813. In brief, a cell (e.g., a somatic cell) from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell (e.g., the somatic cell) is isolated.

Pharmaceutical Compositions

The NOVX nucleic acid molecules, NOVX proteins, and anti-NOVX antibodies (also referred to herein as "active compounds") of the invention, and derivatives, fragments, analogs and homologs thereof, can be incorporated into pharmaceutical compositions suitable for administration. Such compositions typically comprise the nucleic acid molecule, protein, or antibody and a pharmaceutically acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, finger's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., an NOVX protein or anti-NOVX antibody) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The nucleic acid molecules of the invention can be inserted into vectors and used as gene therapy vectors. Gene therapy vectors can be delivered to a subject by, for example, intravenous injection, local administration (see, e.g., U.S. Pat. No. 5,328,470) or by stereotactic injection (see, e.g., Chen, et al., 1994. *Proc. Natl. Acad. Sci. USA* 91: 3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

The pharmaceutical compositions can be included in a container, pack, or dispenser together with instructions for administration.

Screening and Detection Methods

The isolated nucleic acid molecules of the invention can be used to express NOVX protein (e.g., via a recombinant expression vector in a host cell in gene therapy applications), to detect NOVX mRNA (e.g., in a biological sample) or a genetic lesion in an NOVX gene, and to modulate NOVX activity, as described further, below. In addition, the NOVX proteins can be used to screen drugs or compounds that modulate the NOVX protein activity or expression as well as to treat disorders characterized by insufficient or excessive production of NOVX protein or production of NOVX protein forms that have decreased or aberrant activity compared to NOVX wild-type protein (e.g.; diabetes (regulates insulin release); obesity (binds and transport lipids); metabolic disturbances associated with obesity, the metabolic syndrome X as well as anorexia and wasting disorders associated with chronic diseases and various cancers, and infectious disease (possesses anti-microbial activity) and the various dyslipidemias. In addition, the anti-NOVX antibodies of the invention can be used to detect and isolate NOVX proteins and modulate NOVX activity. In yet a further aspect, the invention can be used in methods to influence appetite, absorption of nutrients and the disposition of metabolic substrates in both a positive and negative fashion.

The invention further pertains to novel agents identified by the screening assays described herein and uses thereof for treatments as described, supra.

Screening Assays

The invention provides a method (also referred to herein as a "screening assay") for identifying modulators, i.e., candidate or test compounds or agents (e.g., peptides, peptidomimetics, small molecules or other drugs) that bind to NOVX proteins or have a stimulatory or inhibitory effect on, e.g., NOVX protein expression or NOVX protein activity. The invention also includes compounds identified in the screening assays described herein. In one embodiment, the invention provides assays for screening candidate or test compounds which bind to or modulate the activity of the membrane-bound form of an NOVX protein or polypeptide or biologically-active portion thereof. The test compounds of the invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer or small molecule libraries of compounds. See, e.g., Lam, 1997. *Anticancer Drug Design* 12: 145.

A "small molecule" as used herein, is meant to refer to a composition that has a molecular weight of less than about 5 kD and most preferably less than about 4 kD. Small molecules can be, e.g., nucleic acids, peptides, polypeptides, peptidomimetics, carbohydrates, lipids or other organic or inorganic molecules. Libraries of chemical and/or biological mixtures, such as fungal, bacterial, or algal extracts, are known in the art and can be screened with any of the assays of the invention.

Examples of methods for the synthesis of molecular libraries can be found in the art, for example in: DeWitt, et al., 1993. *Proc. Natl. Acad. Sci. U.S.A.* 90: 6909; Erb, et al., 1994. *Proc. Natl. Acad. Sci. U.S.A.* 91: 11422; Zuckermann, et al., 1994. *J. Med. Chem.* 37: 2678; Cho, et al., 1993. *Science* 261: 1303; Carrell, et al., 1994. *Angew. Chem. Int. Ed. Engl.* 33: 2059; Carell, et al., 1994. *Angew. Chem. Int. Ed. Engl.* 33: 2061; and Gallop, et al., 1994. *J. Med. Chem.* 37: 1233.

Libraries of compounds may be presented in solution (e.g., Houghten, 1992. *Biotechniques* 13: 412–421), or on beads (Lam, 1991. *Nature* 354: 82–84), on chips (Fodor, 1993. *Nature* 364: 555–556), bacteria (Ladner, U.S. Pat. No. 5,223,409), spores (Ladner, U.S. Pat. No. 5,233,409), plasmids (Cull, et al., 1992. *Proc. Natl. Acad. Sci. USA* 89: 1865–1869) or on phage (Scott and Smith, 1990. *Science* 249: 386–390; Devlin, 1990. *Science* 249: 404–406; Cwirla, et al., 1990. *Proc. Natl. Acad. Sci. USA.* 87: 6378–6382; Felici, 1991. *J. Mol. Biol.* 222: 301–310; Ladner, U.S. Pat. No. 5,233,409.).

In one embodiment, an assay is a cell-based assay in which a cell which expresses a membrane-bound form of NOVX protein, or a biologically-active portion thereof, on the cell surface is contacted with a test compound and the ability of the test compound to bind to an NOVX protein determined. The cell, for example, can of mammalian origin or a yeast cell. Determining the ability of the test compound to bind to the NOVX protein can be accomplished, for example, by coupling the test compound with a radioisotope or enzymatic label such that binding of the test compound to the NOVX protein or biologically-active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radioemission or by scintillation counting. Alternatively, test compounds can be enzymatically-labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of NOVX protein, or a biologically-active portion thereof, on the cell surface with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX protein or a biologically-active portion thereof as compared to the known compound.

In another embodiment, an assay is a cell-based assay comprising contacting a cell expressing a membrane-bound form of NOVX protein, or a biologically-active portion thereof, on the cell surface with a test compound and determining the ability of the test compound to modulate (e.g., stimulate or inhibit) the activity of the NOVX protein or biologically-active portion thereof. Determining the ability of the test compound to modulate the activity of NOVX or a biologically-active portion thereof can be accomplished, for example, by determining the ability of the NOVX protein to bind to or interact with an NOVX target molecule. As used herein, a "target molecule" is a molecule with which an NOVX protein binds or interacts in nature, for example, a molecule on the surface of a cell which expresses an NOVX interacting protein, a molecule on the surface of a second cell, a molecule in the extracellular milieu, a molecule associated with the internal surface of a cell membrane or a cytoplasmic molecule. An NOVX target molecule can be a non-NOVX molecule or an NOVX protein or polypeptide of the invention. In one embodiment, an NOVX target molecule is a component of a signal transduction pathway that facilitates transduction of an extracellular signal (e.g. a signal generated by binding of a compound to a membrane-bound NOVX molecule) through the cell membrane and into the cell. The target, for example, can be a second intercellular protein that has catalytic activity or a protein that facilitates the association of downstream signaling molecules with NOVX.

Determining the ability of the NOVX protein to bind to or interact with an NOVX target molecule can be accomplished by one of the methods described above for determining direct binding. In one embodiment, determining the ability of the NOVX protein to bind to or interact with an NOVX target molecule can be accomplished by determining the activity of the target molecule. For example, the activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an NOVX-responsive regulatory element operatively linked to a nucleic acid encoding a detectable marker, e.g., luciferase), or detecting a cellular response, for example, cell survival, cellular differentiation, or cell proliferation.

In yet another embodiment, an assay of the invention is a cell-free assay comprising contacting an NOVX protein or biologically-active portion thereof with a test compound and determining the ability of the test compound to bind to the NOVX protein or biologically-active portion thereof. Binding of the test compound to the NOVX protein can be determined either directly or indirectly as described above. In one such embodiment, the assay comprises contacting the NOVX protein or biologically-active portion thereof with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX or biologically-active portion thereof as compared to the known compound.

In still another embodiment, an assay is a cell-free assay comprising contacting NOVX protein or biologically-active portion thereof with a test compound and determining the ability of the test compound to modulate (e.g. stimulate or inhibit) the activity of the NOVX protein or biologically-active portion thereof. Determining the ability of the test compound to modulate the activity of NOVX can be accomplished, for example, by determining the ability of the NOVX protein to bind to an NOVX target molecule by one of the methods described above for determining direct binding. In an alternative embodiment, determining the ability of the test compound to modulate the activity of NOVX protein can be accomplished by determining the ability of the NOVX protein further modulate an NOVX target molecule. For example, the catalytic/enzymatic activity of the target molecule on an appropriate substrate can be determined as described, supra.

In yet another embodiment, the cell-free assay comprises contacting the NOVX protein or biologically-active portion thereof with a known compound which binds NOVX protein to form an assay mixture, contacting the assay mixture with a test compound, and determining the ability of the test compound to interact with an NOVX protein, wherein determining the ability of the test compound to interact with an NOVX protein comprises determining the ability of the NOVX protein to preferentially bind to or modulate the activity of an NOVX target molecule.

The cell-free assays of the invention are amenable to use of both the soluble form or the membrane-bound form of NOVX protein. In the case of cell-free assays comprising the membrane-bound form of NOVX protein, it may be desirable to utilize a solubilizing agent such that the membrane-bound form of NOVX protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, N-dodecyl--N,N-dimethyl-3-ammonio-1-propane sulfonate, 3-(3-cholamidopropyl)dimethylamminiol-1-propane sulfonate (CHAPS), or 3-(3-cholamidopropyl)dimethylamminiol-2-hydroxy-1-propane sulfonate (CHAPSO).

In more than one embodiment of the above assay methods of the invention, it may be desirable to immobilize either NOVX protein or its target molecule to facilitate separation of complexed from uncomplexed forms of one or both of the proteins, as well as to accommodate automation of the assay. Binding of a test compound to NOVX protein, or interaction of NOVX protein with a target molecule in the presence and absence of a candidate compound, can be accomplished in any vessel suitable for containing the reactants. Examples of such vessels include microtiter plates, test tubes, and microcentrifuge tubes. In one embodiment, a fusion protein can be provided that adds a domain that allows one or both of the proteins to be bound to a matrix. For example, GST-NOVX fusion proteins or GST-target fusion proteins can be adsorbed onto glutathione sepharose beads (Sigma Chemical, St. Louis, Mo.) or glutathione derivatized microtiter plates, that are then combined with the test compound or the test compound and either the non-adsorbed target protein or NOVX protein, and the mixture is incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described, supra. Alternatively, the complexes can be dissociated from the matrix, and the level of NOVX protein binding or activity determined using standard techniques.

Other techniques for immobilizing proteins on matrices can also be used in the screening assays of the invention. For example, either the NOVX protein or its target molecule can be immobilized utilizing conjugation of biotin and streptavidin. Biotinylated NOVX protein or target molecules can be prepared from biotin-NHS(N-hydroxy-succinimide) using techniques well-known within the art (e.g., biotinylation kit, Pierce Chemicals, Rockford, Ill.), and immobilized in the wells of streptavidin-coated 96 well plates (Pierce Chemical). Alternatively, antibodies reactive with NOVX protein or target molecules, but which do not interfere with binding of the NOVX protein to its target molecule, can be derivatized to the wells of the plate, and unbound target or NOVX protein trapped in the wells by antibody conjugation. Methods for detecting such complexes, in addition to those described above for the GST-immobilized complexes, include immunodetection of complexes using antibodies reactive with the NOVX protein or target molecule, as well as enzyme-linked assays that rely on detecting an enzymatic activity associated with the NOVX protein or target molecule.

In another embodiment, modulators of NOVX protein expression are identified in a method wherein a cell is contacted with a candidate compound and the expression of NOVX mRNA or protein in the cell is determined. The level of expression of NOVX mRNA or protein in the presence of the candidate compound is compared to the level of expression of NOVX mRNA or protein in the absence of the candidate compound. The candidate compound can then be identified as a modulator of NOVX mRNA or protein expression based upon this comparison. For example, when expression of NOVX mRNA or protein is greater (i.e., statistically significantly greater) in the presence of the candidate compound than in its absence, the candidate compound is identified as a stimulator of NOVX mRNA or protein expression. Alternatively, when expression of NOVX mRNA or protein is less (statistically significantly less) in the presence of the candidate compound than in its absence, the candidate compound is identified as an inhibitor of NOVX mRNA or protein expression. The level of NOVX mRNA or protein expression in the cells can be determined by methods described herein for detecting NOVX mRNA or protein.

In yet another aspect of the invention, the NOVX proteins can be used as "bait proteins" in a two-hybrid assay or three hybrid assay (see, e.g., U.S. Pat. No. 5,283,317; Zervos, et al., 1993. *Cell* 72: 223–232; Madura, et al., 1993. *J. Biol. Chem.* 268: 12046–12054; Bartel, et al., 1993. *Biotechniques* 14: 920–924; Iwabuchi, et al., 1993. *Oncogene* 8: 1693–1696; and Brent WO 94/10300), to identify other proteins that bind to or interact with NOVX ("NOVX-binding proteins" or "NOVX-bp") and modulate NOVX activity. Such NOVX-binding proteins are also likely to be involved in the propagation of signals by the NOVX proteins as, for example, upstream or downstream elements of the NOVX pathway.

The two-hybrid system is based on the modular nature of most transcription factors, which consist of separable DNA-binding and activation domains. Briefly, the assay utilizes two different DNA constructs. In one construct, the gene that codes for NOVX is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an NOVX-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected and cell colonies containing the functional transcription factor can be isolated and used to obtain the cloned gene that encodes the protein which interacts with NOVX.

The invention further pertains to novel agents identified by the aforementioned screening assays and uses thereof for treatments as described herein.

Detection Assays

Portions or fragments of the cDNA sequences identified herein (and the corresponding complete gene sequences) can be used in numerous ways as polynucleotide reagents. By way of example, and not of limitation, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Some of these applications are described in the subsections, below.

Chromosome Mapping

Once the sequence (or a portion of the sequence) of a gene has been isolated, this sequence can be used to map the location of the gene on a chromosome. This process is called chromosome mapping. Accordingly, portions or fragments of the NOVX sequences, SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or fragments or derivatives thereof, can be used to map the location of the NOVX genes, respectively, on a chromosome. The mapping of the NOVX sequences to chromosomes is an important first step in correlating these sequences with genes associated with disease.

Briefly, NOVX genes can be mapped to chromosomes by preparing PCR primers (preferably 15–25 bp in length) from the NOVX sequences. Computer analysis of the NOVX, sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the NOVX sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but in which human cells can, the one human chromosome that contains the gene encoding the needed enzyme will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. See, e.g., D'Eustachio, et al., 1983. *Science* 220: 919–924. Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the NOVX sequences to design oligonucleotide primers, sub-localization can be achieved with panels of fragments from specific chromosomes.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases, will suffice to get good results in a reasonable amount of time. For a review of this technique, see, Verma, et al., HUMAN CHROMOSOMES: A MANUAL OF BASIC TECHNIQUES (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. Such data are found, e.g., in McKusick, MENDELIAN INHERITANCE IN MAN, available on-line through Johns Hopkins University Welch Medical Library). The relationship between genes and disease, mapped to the same chromosomal region, can then be identified through linkage analysis (co-inheritance of physically adjacent genes), described in, e.g., Egeland, et al., 1987. *Nature*, 325: 783–787.

Moreover, differences in the DNA sequences between individuals affected and unaffected with a disease associated with the NOVX gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The NOVX sequences of the invention can also be used to identify individuals from minute biological samples. In this technique, an individual's genomic DNA is digested with one or more restriction enzymes, and probed on a Southern blot to yield unique bands for identification. The sequences of the invention are useful as additional DNA markers for RFLP ("restriction fragment length polymorphisms," described in U.S. Pat. No. 5,272,057). Furthermore, the sequences of the invention can be used to provide an alternative technique that determines the actual base-by-base DNA sequence of selected portions of an individual's genome. Thus, the NOVX sequences described herein can be used to prepare two PCR primers from the 5'- and 3'-termini of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the invention can be used to obtain such identification sequences from individuals and from tissue. The NOVX sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Much of the allelic variation is due to single nucleotide polymorphisms (SNPs), which include restriction fragment length polymorphisms (RFLPs).

Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences can comfortably provide positive individual identification with a panel of perhaps 10 to 1,000 primers that each yield a noncoding amplified sequence of 100 bases. If predicted coding sequences, such as those in SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59 are used, a more appropriate number of primers for positive individual identification would be 500–2,000.

Predictive Medicine

The invention also pertains to the field of predictive medicine in which diagnostic assays, prognostic assays, pharmacogenomics, and monitoring clinical trials are used for prognostic (predictive) purposes to thereby treat an individual prophylactically. Accordingly, one aspect of the invention relates to diagnostic assays for determining NOVX protein and/or nucleic acid expression as well as NOVX activity, in the context of a biological sample (e.g., blood, serum, cells, tissue) to thereby determine whether an individual is afflicted with a disease or disorder, or is at risk of developing a disorder, associated with aberrant NOVX expression or activity. The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers. The invention also provides for prognostic (or predictive) assays for determining whether an individual is at risk of developing a disorder associated with NOVX protein, nucleic acid expression or activity. For example, mutations in an NOVX gene can be assayed in a biological sample. Such assays can be used for prognostic or predictive purpose to thereby prophylactically treat an individual prior to the onset of a disorder characterized by or associated with NOVX protein, nucleic acid expression, or biological activity.

Another aspect of the invention provides methods for determining NOVX protein, nucleic acid expression or activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.) Yet another aspect of the invention pertains to monitoring the influence of agents (e.g., drugs, compounds) on the expression or activity of NOVX in clinical trials.

These and other agents are described in further detail in the following sections.

Diagnostic Assays

An exemplary method for detecting the presence or absence of NOVX in a biological sample involves obtaining a biological sample from a test subject and contacting the biological sample with a compound or an agent capable of detecting NOVX protein or nucleic acid (e.g., mRNA, genomic DNA) that encodes NOVX protein such that the presence of NOVX is detected in the biological sample. An agent for detecting NOVX mRNA or genomic DNA is a labeled nucleic acid probe capable of hybridizing to NOVX mRNA or genomic DNA. The nucleic acid probe can be, for example, a full-length NOVX nucleic acid, such as the nucleic acid of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, and 59, or a portion thereof, such as an oligonucleotide of at least 15, 30, 50, 100, 250 or 500 nucleotides in length and sufficient to specifically hybridize under stringent conditions to NOVX mRNA or genomic DNA. Other suitable probes for use in the diagnostic assays of the invention are described herein.

An agent for detecting NOVX protein is an antibody capable of binding to NOVX protein, preferably an antibody with a detectable label. Antibodies can be polyclonal, or more preferably, monoclonal. An intact antibody, or a fragment thereof (e.g., Fab or $F(ab')_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. That is, the detection method of the invention can be used to detect NOVX mRNA, protein, or genomic DNA in a biological sample in vitro as well as in vivo. For example, in vitro techniques for detection of NOVX mRNA include Northern hybridizations and in situ hybridizations. In vitro techniques for detection of NOVX protein include enzyme linked immunosorbent assays (ELISAs), Western blots, immunoprecipitations, and immunofluorescence. In vitro techniques for detection of NOVX genomic DNA include Southern hybridizations. Furthermore, in vivo techniques for detection of NOVX protein include introducing into a subject a labeled anti-NOVX antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting NOVX protein, mRNA, or genomic DNA, such that the presence of NOVX protein, mRNA or genomic DNA is detected in the biological sample, and comparing the presence of NOVX protein, mRNA or genomic DNA in the control sample with the presence of NOVX protein, mRNA or genomic DNA in the test sample.

The invention also encompasses kits for detecting the presence of NOVX in a biological sample. For example, the kit can comprise: a labeled compound or agent capable of detecting NOVX protein or mRNA in a biological sample; means for determining the amount of NOVX in the sample; and means for comparing the amount of NOVX in the sample with a standard. The compound or agent can be packaged in a suitable container. The kit can further comprise instructions for using the kit to detect NOVX protein or nucleic acid.

Prognostic Assays

The diagnostic methods described herein can furthermore be utilized to identify subjects having or at risk of developing a disease or disorder associated with aberrant NOVX expression or activity. For example, the assays described herein, such as the preceding diagnostic assays or the following assays, can be utilized to identify a subject having or at risk of developing a disorder associated with NOVX protein, nucleic acid expression or activity. Alternatively, the prognostic assays can be utilized to identify a subject having or at risk for developing a disease or disorder. Thus, the invention provides a method for identifying a disease or disorder associated with aberrant NOVX expression or activity in which a test sample is obtained from a subject and NOVX protein or nucleic acid (e.g., mRNA, genomic DNA) is detected, wherein the presence of NOVX protein or nucleic acid is diagnostic for a subject having or at risk of developing a disease or disorder associated with aberrant NOVX expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant NOVX expression or activity. For example, such methods can be used to determine whether a subject can be effectively treated with an agent for a disorder. Thus, the invention provides methods for determining whether a subject can be effectively treated with an agent for a disorder associated with aberrant NOVX expression or activity in which a test sample is obtained and NOVX protein or nucleic acid is detected (e.g., wherein the presence of NOVX protein or nucleic acid is diagnostic for a subject that can be administered the agent to treat a disorder associated with aberrant NOVX expression or activity).

The methods of the invention can also be used to detect genetic lesions in an NOVX gene, thereby determining if a subject with the lesioned gene is at risk for a disorder characterized by aberrant cell proliferation and/or differentiation. In various embodiments, the methods include detecting, in a sample of cells from the subject, the presence or absence of a genetic lesion characterized by at least one of an alteration affecting the integrity of a gene encoding an NOVX-protein, or the misexpression of the NOVX gene. For example, such genetic lesions can be detected by ascertaining the existence of at least one of: (i) a deletion of one or more nucleotides from an NOVX gene; (ii) an addition of one or more nucleotides to an NOVX gene; (iii) a substitution of one or more nucleotides of an NOVX gene, (iv) a chromosomal rearrangement of an NOVX gene; (v) an alteration in the level of a messenger RNA transcript of an NOVX gene, (vi) aberrant modification of an NOVX gene, such as of the methylation pattern of the genomic DNA, (vii) the presence of a non-wild-type splicing pattern of a messenger RNA transcript of an NOVX gene, (viii) a non-wild-type level of an NOVX protein, (ix) allelic loss of an NOVX gene, and (x) inappropriate post-translational modification of an NOVX protein. As described herein, there are a large number of assay techniques known in the art which can be used for detecting lesions in an NOVX gene. A preferred biological sample is a peripheral blood leukocyte sample isolated by conventional means from a subject. However, any biological sample containing nucleated cells may be used, including, for example, buccal mucosal cells.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran, et al., 1988. *Science* 241: 1077–1080; and Nakazawa, et al., 1994. *Proc. Natl. Acad. Sci. USA* 91: 360–364), the latter of which can be particularly useful for detecting point mutations in the NOVX-gene (see, Abravaya, et al., 1995. Nucl. Acids Res. 23: 675–682). This method can include the steps of collecting a sample of cells from a patient, isolating nucleic acid (e.g., genomic, mRNA or both) from the cells of the sample, contacting the nucleic acid sample with one or more primers that specifically hybridize to an NOVX gene under conditions such that hybridization and amplification of the NOVX gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (see, Guatelli, et al., 1990. *Proc. Natl. Acad. Sci. USA* 87: 1874–1878), transcriptional amplification system (see, Kwoh, et al., 1989. *Proc. Natl. Acad. Sci. USA* 86: 1173–1177); Qβ Replicase (see, Lizardi, et al, 1988. *BioTechnology* 6: 1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an NOVX gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,493,531) can be used to score for the presence of specific mutations by development or loss of a ribozyme cleavage site.

In other embodiments, genetic mutations in NOVX can be identified by hybridizing a sample and control nucleic acids, e.g., DNA or RNA, to high-density arrays containing hundreds or thousands of oligonucleotides probes. See, e.g., Cronin, et al., 1996. *Human Mutation* 7: 244–255; Kozal, et al., 1996. *Nat. Med.* 2: 753–759. For example, genetic mutations in NOVX can be identified in two dimensional arrays containing light-generated DNA probes as described in Cronin, et al., supra. Briefly, a first hybridization array of probes can be used to scan through long stretches of DNA in a sample and control to identify base changes between the sequences by making linear arrays of sequential overlapping probes. This step allows the identification of point mutations. This is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the NOVX gene and detect mutations by comparing the sequence of the sample NOVX with the corresponding wild-type (control) sequence. Examples of sequencing reactions include those based on techniques developed by Maxim and Gilbert, 1977. *Proc. Natl. Acad. Sci. USA* 74: 560 or Sanger, 1977. *Proc. Natl. Acad. Sci. USA* 74: 5463. It is also contemplated that any of a variety of automated sequencing procedures can be utilized when performing the diagnostic assays (see, e.g., Naeve, et al., 1995. *Biotechniques* 19: 448), including sequencing by mass spectrometry (see, e.g., PCT International Publication No. WO 94/16101; Cohen, et al., 1996. *Adv. Chromatography* 36: 127–162; and Griffin, et al., 1993. *Appl. Biochem. Biotechnol.* 38: 147–159).

Other methods for detecting mutations in the NOVX gene include methods in which protection from cleavage agents is used to detect mismatched bases in RNA/RNA or RNA/DNA heteroduplexes. See, e.g., Myers, et al., 1985. *Science* 230: 1242. In general, the art technique of "mismatch cleavage" starts by providing heteroduplexes of formed by hybridizing (labeled) RNA or DNA containing the wild-type NOVX sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with $S_1$ nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton, et al., 1988. *Proc. Natl. Acad. Sc. USA* 85: 4397; Saleeba, et al., 1992. *Methods Enzymol.* 217: 286–295. In an embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in NOVX cDNAs obtained from samples of cells. For example, the mutY enzyme of *E. coli* cleaves A at G/A mismatches and the thymidine DNA glycosylase from HeLa cells cleaves T at G/T mismatches. See, e.g., Hsu, et al., 1994. *Carcinogenesis* 15: 1657–1662. According to an exemplary embodiment, a probe based on an NOVX sequence, e.g., a wild-type NOVX sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in NOVX genes. For example, single strand conformation polymorphism (SSCP) may be used to detect differences in electrophoretic mobility between mutant and wild type nucleic acids. See, e.g., Orita, et al., 1989. *Proc. Natl. Acad. Sci. USA:* 86: 2766; Cotton, et al., 1993. *Mutat. Res.* 285: 125–144; Hayashi, 1992. *Genet. Anal. Tech. Appl.* 9: 73–79. Single-stranded DNA fragments of sample and control NOVX nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In one embodiment, the subject method utilizes heteroduplex analysis to separate double stranded heteroduplex molecules on the basis of changes in electrophoretic mobility. See, e.g., Keen, et al., 1991. *Trends Genet.* 7: 5.

In yet another embodiment, the movement of mutant or wild-type fragments in polyacrylamide gels containing a gradient of denaturant is assayed using denaturing gradient gel electrophoresis (DGGE). See, e.g., Myers, et al., 1985. *Nature* 313: 495. When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA. See, e.g., Rosenbaum and Reissner, 1987. *Biophys. Chem.* 265: 12753.

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions that permit hybridization only if a perfect match is found. See, e.g., Saiki, et al., 1986. *Nature* 324: 163; Saiki, et al., 1989. *Proc. Natl. Acad. Sci. USA* 86: 6230. Such allele specific oligonucleotides are hybridized to PCR amplified target DNA or a number of different mutations when the oligonucleotides are attached to the hybridizing membrane and hybridized with labeled target DNA.

Alternatively, allele specific amplification technology that depends on selective PCR amplification may be used in conjunction with the instant invention. Oligonucleotides used as primers for specific amplification may carry the mutation of interest in the center of the molecule (so that amplification depends on differential hybridization; see, e.g., Gibbs, et al., 1989. *Nucl. Acids Res.* 17: 2437–2448) or at the extreme 3'-terminus of one primer where, under appropriate conditions, mismatch can prevent, or reduce polymerase extension (see, e.g., Prossner, 1993. *Tibtech.* 11: 238). In addition it may be desirable to introduce a novel restriction site in the region of the mutation to create cleavage-based detection. See, e.g., Gasparini, et al., 1992. *Mol. Cell Probes* 6: 1. It is anticipated that in certain embodiments amplification may also be performed using Taq ligase for amplification. See, e.g., Barany, 1991. *Proc. Natl. Acad. Sci. USA* 88: 189. In such cases, ligation will occur only if there is a perfect match at the 3'-terminus of the 5' sequence, making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an NOVX gene.

Furthermore, any cell type or tissue, preferably peripheral blood leukocytes, in which NOVX is expressed may be utilized in the prognostic assays described herein. However, any biological sample containing nucleated cells may be used, including, for example, buccal mucosal cells.

Pharmacogenomics

Agents, or modulators that have a stimulatory or inhibitory effect on NOVX activity (e.g., NOVX gene expression), as identified by a screening assay described herein can be administered to individuals to treat (prophylactically or therapeutically) disorders (The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers.) In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of NOVX protein, expression of NOVX nucleic acid, or mutation content of NOVX genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See e.g., Eichelbaum, 1996. *Clin. Exp. Pharmacol. Physiol.*, 23: 983–985; Linder, 1997. *Clin. Chem.*, 43: 254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, the activity of NOVX protein, expression of NOVX nucleic acid, or mutation content of NOVX genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with an NOVX modulator, such as a modulator identified by one of the exemplary screening assays described herein.

Monitoring of Effects During Clinical Trials

Monitoring the influence of agents (e.g., drugs, compounds) on the expression or activity of NOVX (e.g., the ability to modulate aberrant cell proliferation and/or differentiation) can be applied not only in basic drug screening, but also in clinical trials. For example, the effectiveness of an agent determined by a screening assay as described herein to increase NOVX gene expression, protein levels, or upregulate NOVX activity, can be monitored in clinical trails of subjects exhibiting decreased NOVX gene expression, protein levels, or downregulated NOVX activity. Alternatively, the effectiveness of an agent determined by a screening assay to decrease NOVX gene expression, protein levels, or downregulate NOVX activity, can be monitored in clinical trails of subjects exhibiting increased NOVX gene expression, protein levels, or upregulated NOVX activity. In such clinical trials, the expression or activity of NOVX and, preferably, other genes that have been implicated in, for example, a cellular proliferation or immune disorder can be used as a "read out" or markers of the immune responsiveness of a particular cell.

By way of example, and not of limitation, genes, including NOVX, that are modulated in cells by treatment with an agent (e.g., compound, drug or small molecule) that modulates NOVX activity (e.g., identified in a screening assay as described herein) can be identified. Thus, to study the effect of agents on cellular proliferation disorders, for example, in a clinical trial, cells can be isolated and RNA prepared and analyzed for the levels of expression of NOVX and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of NOVX or other genes. In this manner, the gene expression pattern can serve as a marker, indicative of the physiological response of the cells to the agent. Accordingly, this response state may be determined before, and at various points during, treatment of the individual with the agent.

In one embodiment, the invention provides a method for monitoring the effectiveness of treatment of a subject with an agent (e.g., an agonist, antagonist, protein, peptide, peptidomimetic, nucleic acid, small molecule, or other drug candidate identified by the screening assays described herein) comprising the steps of (i) obtaining a pre-administration sample from a subject prior to administration of the agent; (ii) detecting the level of expression of an NOVX protein, mRNA, or genomic DNA in the preadministration sample; (iii) obtaining one or more post-administration samples from the subject; (iv) detecting the level of expression or activity of the NOVX protein, mRNA, or genomic DNA in the post-administration samples; (v) comparing the level of expression or activity of the NOVX protein, mRNA, or genomic DNA in the pre-administration sample with the NOVX protein, mRNA, or genomic DNA in the post administration sample or samples; and (vi) altering the administration of the agent to the subject accordingly. For example, increased administration of the agent may be desirable to increase the expression or activity of NOVX to higher levels than detected, i.e., to increase the effectiveness of the agent. Alternatively, decreased administration of the agent may be desirable to decrease expression or activity of NOVX to lower levels than detected, i.e., to decrease the effectiveness of the agent.

Methods of Treatment

The invention provides for both prophylactic and therapeutic methods of treating a subject at risk of (or susceptible to) a disorder or having a disorder associated with aberrant NOVX expression or activity. The disorders include cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, prostate cancer, neoplasm; adenocarcinoma, lymphoma, uterus cancer, fertility, hemophilia, hypercoagulation, idiopathic thrombocytopenic purpura, immunodeficiencies, graft versus host disease, AIDS, bronchial asthma, Crohn's disease; multiple sclerosis, treatment of Albright Hereditary Ostoeodystrophy, and other diseases, disorders and conditions of the like.

These methods of treatment will be discussed more fully, below.

Disease and Disorders

Diseases and disorders that are characterized by increased (relative to a subject not suffering from the disease or disorder) levels or biological activity may be treated with Therapeutics that antagonize (i.e., reduce or inhibit) activity. Therapeutics that antagonize activity may be administered in a therapeutic or prophylactic manner. Therapeutics that may be utilized include, but are not limited to: (i) an aforementioned peptide, or analogs, derivatives, fragments or homologs thereof; (ii) antibodies to an aforementioned peptide; (iii) nucleic acids encoding an aforementioned peptide; (iv) administration of antisense nucleic acid and nucleic acids that are "dysfunctional" (i.e., due to a heterologous insertion within the coding sequences of coding sequences to an aforementioned peptide) that are utilized to "knockout" endogenous function of an aforementioned peptide by homologous recombination (see, e.g., Capecchi, 1989. *Science* 244: 1288–1292); or (v) modulators (i.e., inhibitors, agonists and antagonists, including additional peptide mimetic of the invention or antibodies specific to a peptide of the invention) that alter the interaction between an aforementioned peptide and its binding partner.

Diseases and disorders that are characterized by decreased (relative to a subject not suffering from the disease or disorder) levels or biological activity may be treated with Therapeutics that increase (i.e., are agonists to) activity. Therapeutics that upregulate activity may be administered in a therapeutic or prophylactic manner. Therapeutics that may be utilized include, but are not limited to, an aforementioned peptide, or analogs, derivatives, fragments or homologs thereof; or an agonist that increases bioavailability.

Increased or decreased levels can be readily detected by quantifying peptide and/or RNA, by obtaining a patient tissue sample (e.g., from biopsy tissue) and assaying it in vitro for RNA or peptide levels, structure and/or activity of the expressed peptides (or mRNAs of an aforementioned peptide). Methods that are well-known within the art include, but are not limited to, immunoassays (e.g., by Western blot analysis, immunoprecipitation followed by sodium dodecyl sulfate (SDS) polyacrylamide gel electrophoresis, immunocytochemistry, etc.) and/or hybridization assays to detect expression of mRNAs (e.g., Northern assays, dot blots, in situ hybridization, and the like).

Prophylactic Methods

In one aspect, the invention provides a method for preventing, in a subject, a disease or condition associated with an aberrant NOVX expression or activity, by administering to the subject an agent that modulates NOVX expression or at least one NOVX activity. Subjects at risk for a disease that is caused or contributed to by aberrant NOVX expression or activity can be identified by, for example, any or a combination of diagnostic or prognostic assays as described herein. Administration of a prophylactic agent can occur prior to the manifestation of symptoms characteristic of the NOVX aberrancy, such that a disease or disorder is prevented or, alternatively, delayed in its progression. Depending upon the type of NOVX aberrancy, for example, an NOVX agonist or NOVX antagonist agent can be used for treating the subject. The appropriate agent can be determined based on screening assays described herein. The prophylactic methods of the invention are further discussed in the following subsections.

Therapeutic Methods

Another aspect of the invention pertains to methods of modulating NOVX expression or activity for therapeutic purposes. The modulatory method of the invention involves contacting a cell with an agent that modulates one or more of the activities of NOVX protein activity associated with the cell. An agent that modulates NOVX protein activity can be an agent as described herein, such as a nucleic acid or a protein, a naturally-occurring cognate ligand of an NOVX protein, a peptide, an NOVX peptidomimetic, or other small molecule. In one embodiment, the agent stimulates one or more NOVX protein activity. Examples of such stimulatory agents include active NOVX protein and a nucleic acid molecule encoding NOVX that has been introduced into the cell. In another embodiment, the agent inhibits one or more NOVX protein activity. Examples of such inhibitory agents include antisense NOVX nucleic acid molecules and anti-NOVX antibodies. These modulatory methods can be performed in vitro (e.g., by culturing the cell with the agent) or, alternatively, in vivo (e.g., by administering the agent to a subject). As such, the invention provides methods of treating an individual afflicted with a disease or disorder characterized by aberrant expression or activity of an NOVX protein or nucleic acid molecule. In one embodiment, the method involves administering an agent (e.g., an agent identified by a screening assay described herein), or combination of agents that modulates (e.g., up-regulates or down-regulates) NOVX expression or activity. In another embodiment, the method involves administering an NOVX protein or nucleic acid molecule as therapy to compensate for reduced or aberrant NOVX expression or activity.

Stimulation of NOVX activity is desirable in situations in which NOVX is abnormally downregulated and/or in which increased NOVX activity is likely to have a beneficial effect. One example of such a situation is where a subject has a disorder characterized by aberrant cell proliferation and/or differentiation (e.g., cancer or immune associated disorders). Another example of such a situation is where the subject has a gestational disease (e.g., preclampsia).

Determination of the Biological Effect of the Therapeutic

In various embodiments of the invention, suitable in vitro or in vivo assays are performed to determine the effect of a specific Therapeutic and whether its administration is indicated for treatment of the affected tissue.

In various specific embodiments, in vitro assays may be performed with representative cells of the type(s) involved in the patient's disorder, to determine if a given Therapeutic exerts the desired effect upon the cell type(s). Compounds for use in therapy may be tested in suitable animal model systems including, but not limited to rats, mice, chicken, cows, monkeys, rabbits, and the like, prior to testing in human subjects. Similarly, for in vivo testing, any of the animal model system known in the art may be used prior to administration to human subjects.

Prophylactic and Therapeutic Uses of the Compositions of the Invention

The NOVX nucleic acids and proteins of the invention are useful in potential prophylactic and therapeutic applications implicated in a variety of disorders including, but not limited to: metabolic disorders, diabetes, obesity, infectious disease, anorexia, cancer-associated cancer, neurodegenerative disorders, Alzheimer's Disease, Parkinson's Disorder, immune disorders, hematopoietic disorders, and the various dyslipidemias, metabolic disturbances associated with obesity, the metabolic syndrome X and wasting disorders associated with chronic diseases and various cancers.

As an example, a cDNA encoding the NOVX protein of the invention may be useful in gene therapy, and the protein may be useful when administered to a subject in need thereof. By way of non-limiting example, the compositions of the invention will have efficacy for treatment of patients suffering from: metabolic disorders, diabetes, obesity, infectious disease, anorexia, cancer-associated cachexia, cancer, neurodegenerative disorders, Alzheimer's Disease, Parkinson's Disorder, immune disorders, hematopoietic disorders, and the various dyslipidemias.

Both the novel nucleic acid encoding the NOVX protein, and the NOVX protein of the invention, or fragments thereof, may also be useful in diagnostic applications, wherein the presence or amount of the nucleic acid or the protein are to be assessed. A further use could be as an anti-bacterial molecule (i.e., some peptides have been found to possess anti-bacterial properties). These materials are further useful in the generation of antibodies, which immunospecifically-bind to the novel substances of the invention for use in therapeutic or diagnostic methods.

The invention will be further described in the following examples, which do not limit the scope of the invention described in the claims.

EXAMPLES

Example 1

Identification of NOVX Clones

The novel NOVX target sequences identified in the present invention were subjected to the exon linking process to confirm the sequence. PCR primers were designed by starting at the most upstream sequence available, for the forward primer, and at the most downstream sequence available for the reverse primer. Table 21A shows the sequences of the PCR primers used for obtaining different clones. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The PCR product derived from exon linking was cloned into the pCR2.1 vector from Invitrogen. The resulting bacterial clone has an insert covering the entire open reading frame cloned into the pCR2.1 vector. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported herein.

TABLE 21A

PCR Primers for Exon Linking

| NOVX Clone | Primer 1 (5'—3') | SEQ ID NO | Primer 2 (5'—3') | SEQ ID NO |
|---|---|---|---|---|
| 3 | GTAAATTGGAAGAGTTTGTTCAAGGGAA | 242 | CTTGGAAATCCATCTTTCATTAAGTGAGC | 243 |
| 9 | CTATCTGCCAATTTTCATTGTGGACAG | 244 | TTCGAATTAAGGTTCCAAGGCTATGAG | 245 |
| 12b | CGGGAAGACTCGCCAGCAC | 246 | AAAGCCTTTTATGGGTCTTTGAATTTATTG | 247 |
| 14b | TGCTGAGGGTGCATTTATGTTTCAG | 248 | CCACACGTGGATAATCAAGAGTTGAC | 249 |
| 16b | GCGGCGGCCATGGGAGATA | 250 | AGGAAGGGGAAGCGTCCTCAGTATTC | 251 |
| 16c | GCGGCGGCCATGGGAGATA | 252 | AGGAAGGGGAAGCGTCCTCAGTATTC | 253 |
| 17 | AGCACGCACTTGCCCAGAGCTATC | 254 | CCTATGGCTGAAGGCGGAGGT | 255 |
| 18 | CTGGGTCTCCCCTCCCAC | 256 | GTTTATTCTGAGCACCGGGAA | 257 |
| 20 | AGGCCTGCAGGTGGGTGTC | 258 | CTGCAGGCTCCTACAGCTACTGCC | 259 |

Example 2

Quantitative Expression Analysis of Clones in Various Cells and Tissues

The quantitative expression of various clones was assessed using microtiter plates containing RNA samples from a variety of normal and pathology-derived cells, cell lines and tissues using real time quantitative PCR (RTQ PCR). RTQ PCR was performed on an Applied Biosystems ABI PRISM® 7700 or an ABI PRISM® 7900 HT Sequence Detection System. Various collections of samples are assembled on the plates, and referred to as Panel 1 (containing normal tissues and cancer cell lines), Panel 2 (containing samples derived from tissues from normal and cancer sources), Panel 3 (containing cancer cell lines), Panel 4 (containing cells and cell lines from normal tissues and cells related to inflammatory conditions), Panel 5D/5I (containing human tissues and cell lines with an emphasis on metabolic diseases), AI_comprehensive_panel (containing normal tissue and samples from autoimmune diseases), Panel CNSD.01 (containing central nervous system samples from normal and diseased brains) and CNS_neurodegeneration_panel (containing samples from normal and Alzheimer's diseased brains).

RNA integrity from all samples is controlled for quality by visual assessment of agarose gel electropherograms using 28S and 18S ribosomal RNA staining intensity ratio as a guide (2:1 to 2.5:1 28s:18s) and the absence of low molecular weight RNAs that would be indicative of degradation products. Samples are controlled against genomic DNA contamination by RTQ PCR reactions run in the absence of reverse transcriptase using probe and primer sets designed to amplify across the span of a single exon.

First, the RNA samples were normalized to reference nucleic acids such as constitutively expressed genes (for example, β-actin and GAPDH). Normalized RNA (5 ul) was converted to cDNA and analyzed by RTQ-PCR using One Step RT-PCR Master Mix Reagents (Applied Biosystems; Catalog No. 4309169) and gene-specific primers according to the manufacturer's instructions.

In other cases, non-normalized RNA samples were converted to single strand cDNA (sscDNA) using Superscript II (Invitrogen Corporation; Catalog No. 18064–147) and random hexamers according to the manufacturer's instructions. Reactions containing up to 10 μg of total RNA were performed in a volume of 20 μl and incubated for 60 minutes at 42° C. This reaction can be scaled up to 50 μg of total RNA in a final volume of 100 μl. sscDNA samples are then normalized to reference nucleic acids as described previously, using 1× TaqMan® Universal Master mix (Applied Biosystems; catalog No. 4324020), following the manufacturer's instructions.

Probes and primers were designed for each assay according to Applied Biosystems Primer Express Software package (version I for Apple Computer's Macintosh Power PC) or a similar algorithm using the target sequence as input. Default settings were used for reaction conditions and the following parameters were set before selecting primers: primer concentration=250 nM, primer melting temperature (Tm) range=58°–60° C., primer optimal Tm=59° C., maximum primer difference=2° C., probe does not have 5'G, probe Tm must be 10° C. greater than primer Tm, amplicon size 75 bp to 100 bp. The probes and primers selected (see below) were synthesized by Synthegen (Houston, Tex., USA). Probes were double purified by HPLC to remove uncoupled dye and evaluated by mass spectroscopy to verify coupling of reporter and quencher dyes to the 5' and 3' ends of the probe, respectively. Their final concentrations were: forward and reverse primers, 900 nM each, and probe, 200 nM.

PCR conditions: When working with RNA samples, normalized RNA from each tissue and each cell line was spotted in each well of either a 96 well or a 384-well PCR plate (Applied Biosystems). PCR cocktails included either a single gene specific probe and primers set, or two multiplexed probe and primers sets (a set specific for the target clone and another gene-specific set multiplexed with the target probe). PCR reactions were set up using TaqMan® One-Step RT-PCR Master Mix (Applied Biosystems, Catalog No. 4313803) following manufacturer's instructions. Reverse transcription was performed at 48° C. for 30 minutes followed by amplification/PCR cycles as follows: 95° C. 10 min, then 40 cycles of 95° C. for 15 seconds, 60° C. for 1 minute. Results were recorded as CT values (cycle at which a given sample crosses a threshold level of fluorescence) using a log scale, with the difference in RNA concentration between a given sample and the sample with the lowest CT value being represented as 2 to the power of delta CT. The percent relative expression is then obtained by taking the reciprocal of this RNA difference and multiplying by 100.

When working with sscDNA samples, normalized sscDNA was used as described previously for RNA samples. PCR reactions containing one or two sets of probe and primers were set up as described previously, using 1× TaqMan® Universal Master mix (Applied Biosystems; catalog No. 4324020), following the manufacturer's instructions. PCR amplification was performed as follows: 95° C. 10 min, then 40 cycles of 95° C. for 15 seconds, 60° C. for 1 minute. Results were analyzed and processed as described previously.

Panels 1, 1.1, 1.2, and 1.3D

The plates for Panels 1, 1.1, 1.2 and 1.3D include 2 control wells (genomic DNA control and chemistry control) and 94 wells containing cDNA from various samples. The samples in these panels are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in these panels are widely available through the American Type Culture Collection (ATCC), a repository for cultured cell lines, and were cultured using the conditions recommended by the ATCC. The normal tissues found on these panels are comprised of samples derived from all major organ systems from single adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose.

In the results for Panels 1, 1.1, 1.2 and 1.3D, the following abbreviations are used:
ca.=carcinoma,
*=established from metastasis,
met=metastasis,
s cell var=small cell variant,
non-s=non-sm=non-small,
squam=squamous,
pl. eff=pl effusion=pleural effusion,
glio=glioma,
astro=astrocytoma, and
neuro=neuroblastoma.

General_screening_panel_v1.4

The plates for Panel 1.4 include 2 control wells (genomic DNA control and chemistry control) and 94 wells containing cDNA from various samples. The samples in Panel 1.4 are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in Panel 1.4 are widely available through the American Type Culture Collection (ATCC), a repository for cultured cell lines, and were cultured using the conditions recommended by the ATCC. The normal tissues found on Panel 1.4 are comprised of pools of samples derived from all major organ systems from 2 to 5 different adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose. Abbreviations are as described for Panels 1, 1.1, 1.2, and 1.3D.

Panels 2D and 2.2

The plates for Panels 2D and 2.2 generally include 2 control wells and 94 test samples composed of RNA or cDNA isolated from human tissue procured by surgeons working in close cooperation with the National Cancer Institute's Cooperative Human Tissue Network (CHTN) or the National Disease Research Initiative (NDRI). The tissues are derived from human malignancies and in cases where indicated many malignant tissues have "matched margins" obtained from noncancerous tissue just adjacent to the tumor. These are termed normal adjacent tissues and are denoted "NAT" in the results below. The tumor tissue and the "matched margins" are evaluated by two independent pathologists (the surgical pathologists and again by a pathologist at NDRI or CHTN). This analysis provides a gross histopathological assessment of tumor differentiation grade. Moreover, most samples include the original surgical pathology report that provides information regarding the clinical stage of the patient. These matched margins are taken from the tissue surrounding (i.e. immediately proximal) to the zone of surgery (designated "NAT", for normal adjacent tissue, in Table RR). In addition, RNA and cDNA samples were obtained from various human tissues derived from autopsies performed on elderly people or sudden death victims (accidents, etc.). These tissues were ascertained to be free of disease and were purchased from various commercial sources such as Clontech (Palo Alto, Calif.), Research Genetics, and Invitrogen.

Panel 3D

The plates of Panel 3D are comprised of 94 cDNA samples and two control samples. Specifically, 92 of these samples are derived from cultured human cancer cell lines, 2 samples of human primary cerebellar tissue and 2 controls. The human cell lines are generally obtained from ATCC (American Type Culture Collection), NCI or the German tumor cell bank and fall into the following tissue groups: Squamous cell carcinoma of the tongue, breast cancer, prostate cancer, melanoma, epidermoid carcinoma, sarcomas, bladder carcinomas, pancreatic cancers, kidney cancers, leukemias/lymphomas, ovarian/uterine/cervical, gastric, colon, lung and CNS cancer cell lines. In addition, there are two independent samples of cerebellum. These cells are all cultured under standard recommended conditions and RNA extracted using the standard procedures. The cell lines in panel 3D and 1.3D are of the most common cell lines used in the scientific literature.

Panels 4D, 4R, and 4.1D

Panel 4 includes samples on a 96 well plate (2 control wells, 94 test samples) composed of RNA (Panel 4R) or cDNA (Panels 4D/4.1D) isolated from various human cell lines or tissues related to inflammatory conditions. Total RNA from control normal tissues such as colon and lung (Stratagene, La Jolla, Calif.) and thymus and kidney (Clontech) was employed. Total RNA from liver tissue from cirrhosis patients and kidney from lupus patients was obtained from BioChain (Biochain Institute, Inc., Hayward, Calif.). Intestinal tissue for RNA preparation from patients diagnosed as having Crohn's disease and ulcerative colitis was obtained from the National Disease Research Interchange (NDRI) (Philadelphia, Pa.).

Astrocytes, lung fibroblasts, dermal fibroblasts, coronary artery smooth muscle cells, small airway epithelium, bronchial epithelium, microvascular dermal endothelial cells, microvascular lung endothelial cells, human pulmonary aortic endothelial cells, human umbilical vein endothelial cells were all purchased from Clonetics (Walkersville, Md.) and grown in the media supplied for these cell types by Clonetics. These primary cell types were activated with various cytokines or combinations of cytokines for 6 and/or 12–14 hours, as indicated. The following cytokines were used; IL-1 beta at approximately 1–5 ng/ml, TNF alpha at approximately 5–10 ng/ml, IFN gamma at approximately 20–50 ng/ml, IL-4 at approximately 5–10 ng/ml, IL-9 at approximately 5–10 ng/ml, IL-13 at approximately 5–10 ng/ml. Endothelial cells were sometimes starved for various times by culture in the basal media from Clonetics with 0.1% serum.

Mononuclear cells were prepared from blood of employees at CuraGen Corporation, using Ficoll. LAK cells were prepared from these cells by culture in DMEM 5% FCS (Hyclone), 100 μM non essential amino acids (Gibco/Life Technologies, Rockville, Md.), 1 mM sodium pyruvate (Gibco), mercaptoethanol $5.5\times10^{-5}$M (Gibco), and 10 mM Hepes (Gibco) and Interleukin 2 for 4–6 days. Cells were then either activated with 10–20 ng/ml PMA and 1–2 μg/ml ionomycin, IL-12 at 5–10 ng/ml, IFN gamma at 20–50 ng/ml and IL-18 at 5–10 ng/ml for 6 hours. In some cases, mononuclear cells were cultured for 4–5 days in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) with PHA (phytohemagglutinin) or PWM (pokeweed mitogen) at approximately 5 μg/ml. Samples were taken at 24, 48 and 72 hours for RNA preparation. MLR (mixed lymphocyte reaction) samples were obtained by taking blood from two donors, isolating the mononuclear cells using Ficoll and mixing the isolated mononuclear cells 1:1 at a final concentration of approximately $2\times10^6$ cells/ml in DMEM 5% FCS (Hyclone), 100 μM non essential amino acids (Gibco), 1 mM sodium pyruvate (Gibco), mercaptoethanol ($5.5\times10^{-5}$M) (Gibco), and 10 mM Hepes (Gibco). The MLR was cultured and samples taken at various time points ranging from 1–7 days for RNA preparation.

Monocytes were isolated from mononuclear cells using CD14 Miltenyi Beads, +ve VS selection columns and a Vario Magnet according to the manufacturer's instructions. Monocytes were differentiated into dendritic cells by culture in DMEM 5% fetal calf serum (FCS) (Hyclone, Logan, Utah), 100 μM non essential amino acids (Gibco), 1 mM sodium pyruvate (Gibco), mercaptoethanol $5.5\times10^{-5}$M (Gibco), and 10 mM Hepes (Gibco), 50 ng/ml GMCSF and 5 ng/ml IL-4 for 5–7 days. Macrophages were prepared by culture of monocytes for 5–7 days in DMEM 5% FCS (Hyclone), 100 μM non essential amino acids (Gibco), 1 mM sodium pyruvate (Gibco), mercaptoethanol $5.5\times10^{-5}$M (Gibco), 10 mM Hepes (Gibco) and 10% AB Human Serum or MCSF at approximately 50 ng/ml. Monocytes, macrophages and dendritic cells were stimulated for 6 and 12–14 hours with lipopolysaccharide (LPS) at 100 ng/ml. Dendritic cells were also stimulated with anti-CD40 monoclonal antibody (Pharmingen) at 10 μg/ml for 6 and 12–14 hours.

CD4 lymphocytes, CD8 lymphocytes and NK cells were also isolated from mononuclear cells using CD4, CD8 and CD56 Miltenyi beads, positive VS selection columns and a Vario Magnet according to the manufacturer's instructions. CD45RA and CD45RO CD4 lymphocytes were isolated by depleting mononuclear cells of CD8, CD56, CD14 and CD19 cells using CD8, CD56, CD14 and CD19 Miltenyi beads and positive selection. CD45RO beads were then used to isolate the CD45RO CD4 lymphocytes with the remaining cells being CD45RA CD4 lymphocytes. CD45RA CD4, CD45RO CD4 and CD8 lymphocytes were placed in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) and plated at $10^6$ cells/ml onto Falcon 6 well tissue culture plates that had been coated overnight with 0.5 μg/ml anti-CD28 (Pharmingen) and 3 ug/ml anti-CD3 (OKT3, ATCC) in PBS. After 6 and 24 hours, the cells were harvested for RNA preparation. To prepare chronically activated CD8 lymphocytes, we activated the isolated CD8 lymphocytes for 4 days on anti-CD28 and anti-CD3 coated plates and then harvested the cells and expanded them in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) and IL-2. The expanded CD8 cells were then activated again with plate bound anti-CD3 and anti-CD28 for 4 days and expanded as before. RNA was isolated 6 and 24 hours after the second activation and after 4 days of the second expansion culture. The isolated NK cells were cultured in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco) and IL-2 for 4–6 days before RNA was prepared.

To obtain B cells, tonsils were procured from NDRI. The tonsil was cut up with sterile dissecting scissors and then passed through a sieve. Tonsil cells were then spun down and resupended at $10^6$ cells/ml in DMEM 5% FCS (Hyclone), 100 μM non essential amino acids (Gibco), 1 mM sodium pyruvate (Gibco), mercaptoethanol $5.5\times10^{-5}$M (Gibco), and 10 mM Hepes (Gibco). To activate the cells, we used PWM at 5 μg/ml or anti-CD40 (Pharmingen) at approximately 10 μg/ml and IL-4 at 5–10 ng/ml. Cells were harvested for RNA preparation at 24, 48 and 72 hours.

To prepare the primary and secondary Th1/Th2 and Tr1 cells, six-well Falcon plates were coated overnight with 10 μg/ml anti-CD28 (Pharmingen) and 2 μg/ml OKT3 (ATCC), and then washed twice with PBS. Umbilical cord blood CD4 lymphocytes (Poietic Systems, German Town, Md.) were cultured at $10^5$–$10^6$ cells/ml in DMEM 5% FCS (Hyclone), 100 μM non essential amino acids (Gibco), 1 mM sodium pyruvate (Gibco), mercaptoethanol $5.5\times10^{-5}$M (Gibco), 10 mM Hepes (Gibco) and IL-2 (4 ng/ml). IL-12 (5 ng/ml) and anti-IL4 (1 μg/ml) were used to direct to Th1, while IL-4 (5 ng/ml) and anti-IFN gamma (1 μg/ml) were used to direct to Th2 and IL-10 at 5 ng/ml was used to direct to Tr1. After 4–5 days, the activated Th1, Th2 and Tr1 lymphocytes were washed once in DMEM and expanded for 4–7 days in DMEM 5% FCS (Hyclone), 100 μM non essential amino acids (Gibco), 1 mM sodium pyruvate (Gibco), mercaptoethanol $5.5\times10^{-5}$M (Gibco), 10 mM Hepes (Gibco) and IL-2 (1 ng/ml). Following this, the activated Th1, Th2 and Tr1 lymphocytes were re-stimulated for 5 days with anti-CD28/OKT3 and cytokines as described above, but with the addition of anti-CD95L (1 μg/ml) to prevent apoptosis. After 4–5 days, the Th1, Th2 and Tr1 lymphocytes were washed and then expanded again with IL-2 for 4–7 days. Activated Th1 and Th2 lymphocytes were maintained in this way for a maximum of three cycles. RNA was prepared from primary and secondary Th1, Th2 and Tr1 after 6 and 24 hours following the second and third activations with plate bound anti-CD3 and anti-CD28 mAbs and 4 days into the second and third expansion cultures in Interleukin 2.

The following leukocyte cells lines were obtained from the ATCC: Ramos, EOL-1, KU-812. EOL cells were further differentiated by culture in 0.1 mM dbcAMP at $5\times10^5$ cells/ml for 8 days, changing the media every 3 days and adjusting the cell concentration to $5\times10^5$ cells/ml. For the culture of these cells, we used DMEM or RPMI (as recommended by the ATCC), with the addition of 5% FCS (Hyclone), 100 µM non essential amino acids (Gibco), 1 mM sodium pyruvate (Gibco), mercaptoethanol $5.5\times10^{-5}$M (Gibco), 10 mM Hepes (Gibco). RNA was either prepared from resting cells or cells activated with PMA at 10 ng/ml and ionomycin at 1 µg/ml for 6 and 14 hours. Keratinocyte line CCD106 and an airway epithelial tumor line NCI-H292 were also obtained from the ATCC. Both were cultured in DMEM 5% FCS (Hyclone), 100 µM non essential amino acids (Gibco), 1 mM sodium pyruvate (Gibco), mercaptoethanol $5.5\times10^{-5}$M (Gibco), and 10 mM Hepes (Gibco). CCD1106 cells were activated for 6 and 14 hours with approximately 5 ng/ml TNF alpha and 1 ng/ml IL-1 beta, while NCI-H292 cells were activated for 6 and 14 hours with the following cytokines: 5 ng/ml IL-4, 5 ng/ml IL-9, 5 ng/ml IL-13 and 25 ng/ml IFN gamma.

For these cell lines and blood cells, RNA was prepared by lysing approximately $10^7$ cells/ml using Trizol (Gibco BRL). Briefly, 1/10 volume of bromochloropropane (Molecular Research Corporation) was added to the RNA sample, vortexed and after 10 minutes at room temperature, the tubes were spun at 14,000 rpm in a Sorvall SS34 rotor. The aqueous phase was removed and placed in a 15 ml Falcon Tube. An equal volume of isopropanol was added and left at −20° C. overnight. The precipitated RNA was spun down at 9,000 rpm for 15 min in a Sorvall SS34 rotor and washed in 70% ethanol. The pellet was redissolved in 300 µl of RNAse-free water and 35 µl buffer (Promega) 5 µl DTT, 7 µl RNAsin and 8 µl DNAse were added. The tube was incubated at 37° C. for 30 minutes to remove contaminating genomic DNA, extracted once with phenol chloroform and re-precipitated with 1/10 volume of 3M sodium acetate and 2 volumes of 100% ethanol. The RNA was spun down and placed in RNAse free water. RNA was stored at −80° C.

AI_comprehensive panel_v1.0

The plates for AI_comprehensive panel_v1.0 include two control wells and 89 test samples comprised of cDNA isolated from surgical and postmortem human tissues obtained from the Backus Hospital and Clinomics (Frederick, Md.). Total RNA was extracted from tissue samples from the Backus Hospital in the Facility at CuraGen. Total RNA from other tissues was obtained from Clinomics.

Joint tissues including synovial fluid, synovium, bone and cartilage were obtained from patients undergoing total knee or hip replacement surgery at the Backus Hospital. Tissue samples were immediately snap frozen in liquid nitrogen to ensure that isolated RNA was of optimal quality and not degraded. Additional samples of osteoarthritis and rheumatoid arthritis joint tissues were obtained from Clinomics. Normal control tissues were supplied by Clinomics and were obtained during autopsy of trauma victims.

Surgical specimens of psoriatic tissues and adjacent matched tissues were provided as total RNA by Clinomics. Two male and two female patients were selected between the ages of 25 and 47. None of the patients were taking prescription drugs at the time samples were isolated.

Surgical specimens of diseased colon from patients with ulcerative colitis and Crohns disease and adjacent matched tissues were obtained from Clinomics. Bowel tissue from three female and three male Crohn's patients between the ages of 41–69 were used. Two patients were not on prescription medication while the others were taking dexamethasone, phenobarbital, or tylenol. Ulcerative colitis tissue was from three male and four female patients. Four of the patients were taking lebvid and two were on phenobarbital.

Total RNA from post mortem lung tissue from trauma victims with no disease or with emphysema, asthma or COPD was purchased from Clinomics. Emphysema patients ranged in age from 40–70 and all were smokers, this age range was chosen to focus on patients with cigarette-linked emphysema and to avoid those patients with alpha-1antitrypsin deficiencies. Asthma patients ranged in age from 36–75, and excluded smokers to prevent those patients that could also have COPD. COPD patients ranged in age from 35–80 and included both smokers and non-smokers. Most patients were taking corticosteroids, and bronchodilators.

In the labels employed to identify tissues in the AI_comprehensive panel_v1.0 panel, the following abbreviations are used:

AI=Autoimmunity
Syn=Synovial
Normal=No apparent disease
Rep22/Rep20=individual patients
RA=Rheumatoid arthritis
Backus=From Backus Hospital
OA=Osteoarthritis
(SS) (BA) (MF)=Individual patients
Adj=Adjacent tissue
Match control=adjacent tissues
-M=Male
-F=Female
COPD=Chronic obstructive pulmonary disease
Panels 5D and 5I The plates for Panel 5D and 5I include two control wells and a variety of cDNAs isolated from human tissues and cell lines with an emphasis on metabolic diseases. Metabolic tissues were obtained from patients enrolled in the Gestational Diabetes study. Cells were obtained during different stages in the differentiation of adipocytes from human mesenchymal stem cells. Human pancreatic islets were also obtained.

In the Gestational Diabetes study subjects are young (18–40 years), otherwise healthy women with and without gestational diabetes undergoing routine (elective) Cesarean section. After delivery of the infant, when the surgical incisions were being repaired/closed, the obstetrician removed a small sample.

Patient 2: Diabetic Hispanic, overweight, not on insulin
Patient 7–9: Nondiabetic Caucasian and obese (BMI>30)
Patient 10: Diabetic Hispanic, overweight, on insulin
Patient 11: Nondiabetic African American and overweight
Patient 12: Diabetic Hispanic on insulin Adipocyte differentiation was induced in donor progenitor cells obtained from Osirus (a division of Clonetics/BioWhittaker) in triplicate, except for Donor 3U which had only two replicates. Scientists at Clonetics isolated, grew and differentiated human mesenchymal stem cells (HuMSCs) for CuraGen based on the published protocol found in Mark F. Pittenger, et al., Multilineage Potential of Adult Human Mesenchymal Stem Cells Science Apr. 2, 1999: 143–147. Clonetics provided Trizol lysates or frozen pellets suitable for mRNA isolation and ds cDNA production. A general description of each donor is as follows:

Donor 2 and 3 U: Mesenchymal Stem cells, Undifferentiated Adipose

Donor 2 and 3 µM: Adipose, AdiposeMidway Differentiated

Donor 2 and 3 AD: Adipose, Adipose Differentiated

Human cell lines were generally obtained from ATCC (American Type Culture Collection), NCI or the German tumor cell bank and fall into the following tissue groups: kidney proximal convoluted tubule, uterine smooth muscle cells, small intestine, liver HepG2 cancer cells, heart primary stromal cells, and adrenal cortical adenoma cells. These cells are all cultured under standard recommended conditions and RNA extracted using the standard procedures. All samples were processed at CuraGen to produce single stranded cDNA.

Panel 5I contains all samples previously described with the addition of pancreatic islets from a 58 year old female patient obtained from the Diabetes Research Institute at the University of Miami School of Medicine. Islet tissue was processed to total RNA at an outside source and delivered to CuraGen for addition to panel 5I.

In the labels employed to identify tissues in the 5D and 5I panels, the following abbreviations are used:

GO Adipose=Greater Omentum Adipose
SK=Skeletal Muscle
UT=Uterus
PL=Placenta
AD=Adipose Differentiated
AM=Adipose Midway Differentiated
U=Undifferentiated Stem Cells
Panel CNSD.01

The plates for Panel CNSD.01 include two control wells and 94 test samples comprised of cDNA isolated from postmortem human brain tissue obtained from the Harvard Brain Tissue Resource Center. Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains two brains from each of the following diagnoses: Alzheimer's disease, Parkinson's disease, Huntington's disease, Progressive Supernuclear Palsy, Depression, and "Normal controls". Within each of these brains, the following regions are represented: cingulate gyrus, temporal pole, globus palladus, substantia nigra, Brodman Area 4 (primary motor strip), Brodman Area 7 (parietal cortex), Brodman Area 9 (prefrontal cortex), and Brodman area 17 (occipital cortex). Not all brain regions are represented in all cases; e.g., Huntington's disease is characterized in part by neurodegeneration in the globus palladus, thus this region is impossible to obtain from confirmed Huntington's cases. Likewise Parkinson's disease is characterized by degeneration of the substantia nigra making this region more difficult to obtain. Normal control brains were examined for neuropathology and found to be free of any pathology consistent with neurodegeneration.

In the labels employed to identify tissues in the CNS panel, the following abbreviations are used:

PSP=Progressive supranuclear palsy
Sub Nigra=Substantia nigra
Glob Palladus=Globus palladus
Temp Pole=Temporal pole
Cing Gyr=Cingulate gyrus
BA 4=Brodman Area 4
Panel CNS_Neurodegeneration_V1.0

The plates for Panel CNS_Neurodegeneration_V1.0 include two control wells and 47 test samples comprised of cDNA isolated from postmortem human brain tissue obtained from the Harvard Brain Tissue Resource Center (McLean Hospital) and the Human Brain and Spinal Fluid Resource Center (VA Greater Los Angeles Healthcare System). Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains six brains from Alzheimer's disease (AD) patients, and eight brains from "Normal controls" who showed no evidence of dementia prior to death. The eight normal control brains are divided into two categories: Controls with no dementia and no Alzheimer's like pathology (Controls) and controls with no dementia but evidence of severe Alzheimer's like pathology, (specifically senile plaque load rated as level 3 on a scale of 0–3; 0=no evidence of plaques, 3=severe AD senile plaque load). Within each of these brains, the following regions are represented: hippocampus, temporal cortex (Brodman Area 21), parietal cortex (Brodman area 7), and occipital cortex (Brodman area 17). These regions were chosen to encompass all levels of neurodegeneration in AD. The hippocampus is a region of early and severe neuronal loss in AD; the temporal cortex is known to show neurodegeneration in AD after the hippocampus; the parietal cortex shows moderate neuronal death in the late stages of the disease; the occipital cortex is spared in AD and therefore acts as a "control" region within AD patients. Not all brain regions are represented in all cases.

In the labels employed to identify tissues in the CNS_Neurodegeneration_V1.0 panel, the following abbreviations are used:

AD=Alzheimer's disease brain; patient was demented and showed AD-like pathology upon autopsy Control=Control brains; patient not demented, showing no neuropathology Control (Path)=Control brains; patient not demented but showing sever AD-like pathology SupTemporal Ctx=Superior Temporal Cortex
Inf Temporal Ctx=Inferior Temporal Cortex A. sggc_draft_ba186014_20000730_da1: LYSOSOMAL ACID LIPASE (NOV1)

Expression of gene sggc_draft_ba186014_20000730_da1 was assessed using the primer-probe sets Ag1456, Ag2446, Ag2132, Ag2444, Ag1899 and Ag2059, described in Tables AA, AB, AC, AD, AE and AF. Results of the RTQ-PCR runs are shown in Tables AG, AH, AI, AJ and AK.

TABLE AA

Probe Name Ag1456

| Primers | Sequences | Start Position | SEQ ID NO |
|---|---|---|---|
| Forward | 5'-tcctgaggtgtggatgaatact-3' | 91 | 260 |
| Probe | TET-5'-catcatctacaatggctaccccagtga-3'-TAMRA | 121 | 261 |
| Reverse | 5'-ccatcttcagtggtgacttcat-3' | 153 | 262 |

TABLE AB

Probe Name Ag2446

| Primers | Sequences | Start Position | SEQ ID NO |
|---|---|---|---|
| Forward | 5'-gaaacagtcggggaaacact-3' | 354 | 263 |
| Probe | TET-5'-tggtcaagaagacacaaaacactctca-3'-TAMRA | 374 | 264 |
| Reverse | 5'-aaaccaaaggcccagaattt-3' | 413 | 265 |

TABLE AC

Probe Name Ag2132

| Primers | Sequences | Start Position | SEQ ID NO |
|---|---|---|---|
| Forward | 5'-ggggaaatgacgctgataatat-3' | 858 | 266 |
| Probe | TET-5'-cccctatatatgacctgactgccatg-3'-TAMRA | 903 | 267 |
| Reverse | 5'-cccaaatagcagtaggcacttt-3' | 929 | 268 |

TABLE AD

Probe Name Ag2444

| Primers | Sequences | Start Position | SEQ ID NO |
|---|---|---|---|
| Forward | 5'-gaaacagtcggggaaacact-3' | 354 | 269 |
| Probe | TET-5'-tggtcaagaagacacaaaacactctca-3'-TAMRA | 374 | 270 |
| Reverse | 5'-aaaccaaaggcccagaattt-3' | 413 | 271 |

TABLE AE

Probe Name Ag1899

| Primers | Sequences | Start Position | SEQ ID NO |
|---|---|---|---|
| Forward | 5'-tcctgaggtgtggatgaatact-3' | 91 | 272 |
| Probe | TET-5'-catcatctacaatggctaccccagtga-3'-TAMRA | 121 | 273 |
| Reverse | 5'-ccatcttcagtggtgacttcat-3' | 153 | 274 |

TABLE AF

Probe Name Ag2059

| Primers | Sequences | Start Position | SEQ ID NO |
|---|---|---|---|
| Forward | 5'-ggggaaatgacgctgataatat-3' | 858 | 275 |
| Probe | TET-5'-cccctatatatgacctgactgccatg-3'-TAMRA | 903 | 276 |
| Reverse | 5'-cccaaatagcagtaggcacttt-3' | 929 | 277 |

TABLE AG

AI_comprehensive panel_v1.0

| Tissue Name | Rel. Exp. (%) Ag1456, Run 224501612 | Tissue Name | Rel. Exp. (%) Ag1456, Run 224501612 |
|---|---|---|---|
| 110967 COPD-F | 0.0 | 112427 Match Control Psoriasis-F | 0.0 |
| 110980 COPD-F | 2.1 | 112418 Psoriasis-M | 0.0 |
| 110968 COPD-M | 0.0 | 112723 Match Control Psoriasis-M | 0.0 |
| 110977 COPD-M | 0.0 | 112419 Psoriasis-M | 0.0 |
| 110989 Emphysema-F | 2.6 | 112424 Match Control Psoriasis-M | 0.0 |
| 110992 Emphysema-F | 0.0 | 112420 Psoriasis-M | 4.4 |
| 110993 Emphysema-F | 0.0 | 112425 Match Control Psoriasis-M | 0.0 |
| 110994 Emphysema-F | 0.0 | 104689 (MF) OA Bone-Backus | 0.0 |
| 110995 Emphysema-F | 0.0 | 104690 (MF) Adj "Normal" Bone-Backus | 3.0 |
| 110996 Emphysema-F | 0.0 | 104691 (MF) OA Synovium-Backus | 35.1 |
| 110997 Asthma-M | 5.0 | 104692 (BA) OA Cartilage-Backus | 0.0 |
| 111001 Asthma-F | 1.6 | 104694 (BA) OA Bone-Backus | 3.2 |
| 111002 Asthma-F | 2.5 | 104695 (BA) Adj "Normal" Bone-Backus | 3.1 |
| 111003 Atopic Asthma-F | 0.0 | 104696 (BA) OA Synovium-Backus | 20.9 |
| 111004 Atopic Asthma-F | 0.0 | 104700 (SS) OA Bone-Backus | 39.0 |
| 111005 Atopic Asthma-F | 0.0 | 104701 (SS) Adj "Normal" Bone-Backus | 3.3 |
| 111006 Atopic Asthma-F | 0.0 | 104702 (SS) OA Synovium-Backus | 5.0 |
| 111417 Allergy-M | 0.0 | 117093 OA Cartilage Rep7 | 0.0 |
| 112347 Allergy-M | 0.8 | 112672 OA Bone5 | 0.0 |
| 112349 Normal Lung-F | 0.0 | 112673 OA Synovium5 | 0.0 |
| 112357 Normal Lung-F | 0.0 | 112674 OA Synovial Fluid cells5 | 0.0 |
| 112354 Normal Lung-M | 0.0 | 117100 OA Cartilage Rep14 | 0.0 |
| 112374 Crohns-F | 2.4 | 112756 OA Bone9 | 0.0 |
| 112389 Match Control Crohns-F | 100.0 | 112757 OA Synovium9 | 0.0 |
| 112375 Crohns-F | 0.0 | 112758 OA Synovial Fluid Cells9 | 1.3 |
| 112732 Match Control Crohns-F | 5.0 | 117125 RA Cartilage Rep2 | 0.0 |
| 112725 Crohns-M | 1.5 | 113492 Bone2 RA | 62.0 |
| 112387 Match Control Crohns-M | 0.0 | 113493 Synovium2 RA | 8.7 |
| 112378 Crohns-M | 0.0 | 113494 Syn Fluid Cells RA | 21.0 |
| 112390 Match Control Crohns-M | 2.3 | 113499 Cartilage4 RA | 20.6 |
| 112726 Crohns-M | 0.0 | 113500 Bone4 RA | 25.5 |
| 112731 Match Control Crohns-M | 0.0 | 113501 Synovium4 RA | 15.3 |
| 112380 Ulcer Col-F | 0.0 | 113502 Syn Fluid Cells4 RA | 8.5 |
| 112734 Match Control Ulcer Col-F | 52.5 | 113495 Cartilage3 RA | 33.7 |
| 112384 Ulcer Col-F | 0.0 | 113496 Bone3 RA | 33.7 |
| 112737 Match Control Ulcer Col-F | 2.5 | 113497 Synovium3 RA | 19.9 |
| 112386 Ulcer Col-F | 2.4 | 113498 Syn Fluid Cells3 RA | 37.6 |
| 112738 Match Control Ulcer Col-F | 3.3 | 117106 Normal Cartilage Rep20 | 0.0 |
| 112381 Ulcer Col-M | 0.0 | 113663 Bone3 Normal | 0.0 |
| 112735 Match Control Ulcer Col-M | 1.4 | 113664 Synovium3 Normal | 0.9 |
| 112382 Ulcer Col-M | 28.5 | 113665 Syn Fluid Cells3 Normal | 0.0 |
| 112394 Match Control Ulcer Col-M | 0.0 | 117107 Normal Cartilage Rep22 | 2.4 |
| 112383 Ulcer Col-M | 0.0 | 113667 Bone4 Normal | 0.0 |
| 112736 Match Control Ulcer Col-M | 74.2 | 113668 Synovium4 Normal | 0.0 |
| 112423 Psoriasis-F | 4.4 | 113669 Syn Fluid Cells4 Normal | 0.0 |

TABLE AH

Panel 1.2

| Tissue Name | Rel. Exp. (%) Ag1456, Run 138374123 | Tissue Name | Rel. Exp. (%) Ag1456, Run 138374123 |
|---|---|---|---|
| Endothelial cells | 0.0 | Renal ca. 786-0 | 0.0 |
| Heart (Fetal) | 0.6 | Renal ca. A498 | 0.0 |
| Pancreas | 0.0 | Renal ca. RXF 393 | 0.0 |
| Pancreatic ca. CAPAN 2 | 0.0 | Renal ca. ACHN | 0.0 |
| Adrenal Gland | 10.7 | Renal ca. UO-31 | 0.0 |
| Thyroid | 1.3 | Renal ca. TK-10 | 0.0 |
| Salivary gland | 3.2 | Liver | 4.1 |
| Pituitary gland | 0.3 | Liver (fetal) | 4.5 |
| Brain (fetal) | 0.6 | Liver ca. (hepatoblast) HepG2 | 0.0 |

TABLE AH-continued

Panel 1.2

| Tissue Name | Rel. Exp. (%) Ag1456, Run 138374123 | Tissue Name | Rel. Exp. (%) Ag1456, Run 138374123 |
|---|---|---|---|
| Brain (whole) | 0.0 | Lung | 5.6 |
| Brain (amygdala) | 0.5 | Lung (fetal) | 1.2 |
| Brain (cerebellum) | 0.0 | Lung ca. (small cell) LX-1 | 5.9 |
| Brain (hippocampus) | 0.7 | Lung ca. (small cell) NCI-H69 | 1.7 |
| Brain (thalamus) | 0.7 | Lung ca. (s.cell var.) SHP-77 | 0.0 |
| Cerebral Cortex | 0.0 | Lung ca. (large cell)NCI-H460 | 0.0 |
| Spinal cord | 2.1 | Lung ca. (non-sm. cell) A549 | 0.0 |
| glio/astro U87-MG | 0.0 | Lung ca. (non-s.cell) NCI-H23 | 60.3 |
| glio/astro U-118-MG | 1.8 | Lung ca. (non-s.cell) HOP-62 | 0.0 |
| astrocytoma SW1783 | 0.0 | Lung ca. (non-s.cl) NCI-H522 | 2.8 |
| neuro*; met SK-N-AS | 0.0 | Lung ca. (squam.) SW 900 | 0.0 |
| astrocytoma SF-539 | 0.0 | Lung ca. (squam.) NCI-H596 | 0.0 |
| astrocytoma SNB-75 | 0.0 | Mammary gland | 0.0 |
| glioma SNB-19 | 0.0 | Breast ca.* (pl.ef) MCF-7 | 0.9 |
| glioma U251 | 0.0 | Breast ca.* (pl.ef) MDA-MB-231 | 0.0 |
| glioma SF-295 | 0.0 | Breast ca.* (pl. ef) T47D | 0.0 |
| Heart | 19.9 | Breast ca. BT-549 | 0.0 |
| Skeletal Muscle | 8.2 | Breast ca. MDA-N | 0.0 |
| Bone marrow | 100.0 | Ovary | 0.0 |
| Thymus | 0.6 | Ovarian ca. OVCAR-3 | 0.0 |
| Spleen | 12.3 | Ovarian ca. OVCAR-4 | 0.0 |
| Lymph node | 0.9 | Ovarian ca. OVCAR-5 | 1.4 |
| Colorectal Tissue | 1.9 | Ovarian ca. OVCAR-8 | 0.0 |
| Stomach | 2.0 | Ovarian ca. IGROV-1 | 0.0 |
| Small intestine | 1.2 | Ovarian ca. (ascites) SK-OV-3 | 0.0 |
| Colon ca. SW480 | 0.5 | Uterus | 0.4 |
| Colon ca.* SW620 (SW480 met) | 3.1 | Placenta | 2.2 |
| Colon ca. HT29 | 0.0 | Prostate | 1.4 |
| Colon ca. HCT-116 | 0.0 | Prostate ca.* (bone met) PC-3 | 0.0 |
| Colon ca. CaCo-2 | 0.5 | Testis | 0.0 |
| Colon ca. Tissue (ODO3866) | 8.2 | Melanoma Hs688(A).T | 0.0 |
| Colon ca. HCC-2998 | 0.0 | Melanoma* (met) Hs688(B).T | 0.0 |
| Gastric ca.* (liver met) NCI-N87 | 2.4 | Melanoma UACC-62 | 0.0 |
| Bladder | 29.1 | Melanoma M14 | 0.0 |
| Trachea | 0.6 | Melanoma LOX IMVI | 0.0 |
| Kidney | 3.1 | Melanoma* (met) SK-MEL-5 | 1.2 |
| Kidney (fetal) | 2.5 | | |

TABLE AI

Panel 1.3D

| Tissue Name | Rel. Exp. (%) Ag1456, Run 147644869 | Rel. Exp. (%) Ag1456, Run 165529464 | Rel. Exp. (%) Ag2132, Run 160164823 | Rel. Exp. (%) Ag2444, Run 165629988 |
|---|---|---|---|---|
| Liver adenocarcinoma | 0.0 | 0.0 | 0.0 | 0.0 |
| Pancreas | 0.0 | 0.0 | 0.0 | 1.9 |
| Pancreatic ca. CAPAN 2 | 0.0 | 0.0 | 0.0 | 0.0 |
| Adrenal gland | 9.2 | 7.6 | 5.2 | 1.9 |
| Thyroid | 0.0 | 0.0 | 0.0 | 1.6 |
| Salivary gland | 0.0 | 0.0 | 0.0 | 0.4 |
| Pituitary gland | 0.0 | 0.0 | 0.0 | 0.6 |
| Brain (fetal) | 0.0 | 0.0 | 0.0 | 1.4 |
| Brain (whole) | 0.0 | 0.0 | 0.0 | 0.3 |
| Brain (amygdala) | 0.0 | 0.0 | 0.0 | 0.0 |
| Brain (cerebellum) | 0.0 | 0.0 | 0.0 | 0.0 |
| Brain (hippocampus) | 0.0 | 0.0 | 0.0 | 0.4 |
| Brain (substantia nigra) | 4.6 | 0.0 | 0.0 | 0.4 |
| Brain (thalamus) | 0.0 | 0.0 | 0.0 | 0.0 |
| Cerebral Cortex | 0.0 | 0.0 | 0.0 | 0.5 |
| Spinal cord | 0.0 | 10.4 | 3.5 | 1.2 |
| glio/astro U87-MG | 0.0 | 0.0 | 0.0 | 0.0 |
| glio/astro U-118-MG | 12.4 | 0.0 | 10.7 | 8.5 |
| astrocytoma | 0.0 | 0.0 | 0.0 | 0.0 |

TABLE AI-continued

Panel 1.3D

| Tissue Name | Rel. Exp. (%) Ag1456, Run 147644869 | Rel. Exp. (%) Ag1456, Run 165529464 | Rel. Exp. (%) Ag2132, Run 160164823 | Rel. Exp. (%) Ag2444, Run 165629988 |
|---|---|---|---|---|
| SW1783 neuro*; met SK-N-AS | 0.0 | 0.0 | 0.0 | 0.0 |
| astrocytoma SF-539 | 0.0 | 0.0 | 0.0 | 0.0 |
| astrocytoma SNB-75 | 0.0 | 0.0 | 0.0 | 2.5 |
| glioma SNB-19 | 0.0 | 0.0 | 0.0 | 0.0 |
| glioma U251 | 0.0 | 0.0 | 0.0 | 0.6 |
| glioma SF-295 | 0.0 | 0.0 | 0.0 | 0.0 |
| Heart (fetal) | 5.8 | 0.0 | 0.0 | 0.0 |
| Heart | 0.0 | 0.0 | 0.0 | 0.5 |
| Skeletal muscle (fetal) | 0.0 | 0.0 | 0.0 | 0.3 |
| Skeletal muscle | 0.0 | 6.2 | 5.0 | 0.6 |
| Bone marrow | 100.0 | 100.0 | 66.4 | 0.0 |
| Thymus | 0.0 | 0.0 | 7.2 | 0.0 |
| Spleen | 11.4 | 8.8 | 21.2 | 0.0 |
| Lymph node | 5.0 | 7.4 | 0.0 | 1.3 |
| Colorectal | 0.0 | 0.0 | 0.0 | 0.3 |
| Stomach | 0.0 | 0.0 | 0.0 | 0.9 |
| Small intestine | 0.0 | 0.0 | 0.0 | 0.4 |
| Colon ca. SW480 | 0.0 | 0.0 | 0.0 | 0.0 |
| Colon ca.* SW620(SW480 met) | 0.0 | 0.0 | 0.0 | 0.0 |
| Colon ca. HT29 | 0.0 | 0.0 | 0.0 | 1.1 |
| Colon ca. HCT-116 | 0.0 | 0.0 | 0.0 | 0.0 |
| Colon ca. CaCo-2 | 0.0 | 0.0 | 0.0 | 0.8 |
| Colon ca. tissue(ODO3866) | 10.8 | 17.3 | 23.2 | 0.6 |
| Colon ca. HCC-2998 | 0.0 | 0.0 | 0.0 | 1.4 |
| Gastric ca.* (liver met) NCI-N87 | 0.0 | 0.0 | 1.8 | 100.0 |
| Bladder | 0.0 | 6.7 | 0.0 | 1.5 |
| Trachea | 0.0 | 0.0 | 31.6 | 1.2 |
| Kidney | 0.0 | 0.0 | 0.0 | 0.6 |
| Kidney (fetal) | 5.1 | 0.0 | 0.0 | 0.0 |
| Renal ca. 786-0 | 0.0 | 0.0 | 0.0 | 0.0 |
| Renal ca. A498 | 0.0 | 0.0 | 3.9 | 0.1 |
| Renal ca. RXF 393 | 0.0 | 0.0 | 0.0 | 1.4 |
| Renal ca. ACHN | 0.0 | 0.0 | 0.0 | 24.7 |
| Renal ca. UO-31 | 0.0 | 0.0 | 0.0 | 0.0 |
| Renal ca. TK-10 | 0.0 | 0.0 | 0.0 | 0.0 |
| Liver | 0.0 | 0.0 | 0.0 | 0.0 |
| Liver (fetal) | 3.7 | 0.0 | 0.0 | 0.0 |
| Liver ca. (hepatoblast) HepG2 | 0.0 | 0.0 | 0.0 | 0.0 |
| Lung | 38.4 | 25.0 | 100.0 | 1.3 |
| Lung (fetal) | 18.9 | 5.7 | 15.1 | 0.0 |
| Lung ca. (small cell) LX-1 | 11.7 | 0.0 | 0.0 | 0.3 |
| Lung ca. (small cell) NCI-H69 | 0.0 | 0.0 | 0.0 | 2.3 |
| Lung ca. (s.cell var.) SHP-77 | 0.0 | 0.0 | 0.0 | 0.0 |
| Lung ca. (large cell)NCI-H460 | 0.0 | 0.0 | 0.0 | 0.5 |
| Lung ca. (non-sm. cell)A549 | 0.0 | 0.0 | 0.0 | 3.3 |
| Lung ca. (non-s.cell) NCI-H23 | 38.2 | 17.9 | 10.2 | 21.5 |
| Lung ca. (non-s.cell) HOP-62 | 0.0 | 0.0 | 0.0 | 0.0 |
| Lung ca. (non-s.cl) NCI-H522 | 0.0 | 0.0 | 0.0 | 0.3 |
| Lung ca. (squam.) SW 900 | 0.0 | 0.0 | 0.0 | 2.2 |
| Lung ca. (squam.) NCI-H596 | 0.0 | 0.0 | 0.0 | 0.5 |
| Mammary gland | 0.0 | 0.0 | 0.0 | 0.6 |
| Breast ca.* (pl.ef) MCF-7 | 0.0 | 0.0 | 0.0 | 35.4 |
| Breast ca.* (pl.ef) MDA-MB-231 | 0.0 | 0.0 | 0.0 | 0.0 |

TABLE AI-continued

Panel 1.3D

| Tissue Name | Rel. Exp. (%) Ag1456, Run 147644869 | Rel. Exp. (%) Ag1456, Run 165529464 | Rel. Exp. (%) Ag2132, Run 160164823 | Rel. Exp. (%) Ag2444, Run 165629988 |
|---|---|---|---|---|
| Breast ca.* (pl.ef) T47D | 0.0 | 0.0 | 0.0 | 5.6 |
| Breast ca. BT-549 | 0.0 | 0.0 | 0.0 | 1.7 |
| Breast ca. MDA-N | 0.0 | 0.0 | 0.0 | 0.0 |
| Ovary | 0.0 | 0.0 | 0.0 | 2.3 |
| Ovarian ca. OVCAR-3 | 0.0 | 0.0 | 0.0 | 17.7 |
| Ovarian ca. OVCAR-4 | 0.0 | 0.0 | 0.0 | 17.1 |
| Ovarian ca. OVCAR-5 | 0.0 | 0.0 | 0.0 | 0.9 |
| Ovarian ca. OVCAR-8 | 0.0 | 0.0 | 0.0 | 4.4 |
| Ovarian ca. IGROV-1 | 0.0 | 0.0 | 0.0 | 0.0 |
| Ovarian ca.* (ascites) SK-OV-3 | 0.0 | 0.0 | 0.0 | 8.0 |
| Uterus | 0.0 | 0.0 | 0.0 | 3.0 |
| Placenta | 5.3 | 0.0 | 16.5 | 0.0 |
| Prostate | 0.0 | 0.0 | 0.0 | 0.0 |
| Prostate ca.* (bone met)PC-3 | 0.0 | 0.0 | 0.0 | 32.8 |
| Testis | 5.3 | 0.0 | 0.0 | 1.3 |
| Melanoma Hs688(A).T | 0.0 | 0.0 | 0.0 | 0.0 |
| Melanoma* (met) Hs688(B).T | 0.0 | 0.0 | 0.0 | 0.0 |
| Melanoma UACC-62 | 0.0 | 0.0 | 0.0 | 0.5 |
| Melanoma M14 | 0.0 | 0.0 | 0.0 | 0.6 |
| Melanoma LOX IMVI | 0.0 | 0.0 | 0.0 | 0.0 |
| Melanoma* (met) SK-MEL-5 | 0.0 | 0.0 | 0.0 | 0.0 |
| Adipose | 27.0 | 14.3 | 10.7 | 4.0 |

TABLE AJ

Panel 2D

| Tissue Name | Rel. Exp. (%) Ag1456, Run 147644930 | Rel. Exp. (%) Ag1456, Run 148059395 | Rel. Exp. (%) Ag1456, Run 162599938 | Tissue Name | Rel. Exp. (%) Ag1456, Run 147644930 | Rel. Exp. (%) Ag1456, Run 148059395 | Rel. Exp. (%) Ag1456, Run 162599938 |
|---|---|---|---|---|---|---|---|
| Normal Colon | 13.2 | 2.1 | 6.3 | Kidney Margin 8120608 | 0.0 | 0.6 | 1.0 |
| CC Well to Mod Diff (ODO3866) | 5.5 | 2.4 | 2.6 | Kidney Cancer 8120613 | 1.0 | 0.8 | 0.8 |
| CC Margin (ODO3866) | 2.1 | 3.2 | 2.3 | Kidney Margin 8120614 | 0.0 | 0.0 | 0.0 |
| CC Gr.2 rectosigmoid (ODO3868) | 0.6 | 0.0 | 1.7 | Kidney Cancer 9010320 | 17.9 | 13.8 | 15.0 |
| CC Margin (ODO3868) | 0.0 | 0.0 | 0.8 | Kidney Margin 9010321 | 0.7 | 1.4 | 1.4 |
| CC Mod Diff (ODO3920) | 1.8 | 2.9 | 3.5 | Normal Uterus | 0.0 | 0.0 | 0.0 |
| CC Margin (ODO3920) | 0.5 | 1.2 | 2.6 | Uterus Cancer 064011 | 1.2 | 0.5 | 2.1 |
| CC Gr.2 ascend colon (ODO3921) | 1.3 | 9.2 | 6.5 | Normal Thyroid | 0.0 | 0.6 | 0.7 |

TABLE AJ-continued

Panel 2D

| Tissue Name | Rel. Exp. (%) Ag1456, Run 147644930 | Rel. Exp. (%) Ag1456, Run 148059395 | Rel. Exp. (%) Ag1456, Run 162599938 | Tissue Name | Rel. Exp. (%) Ag1456, Run 147644930 | Rel. Exp. (%) Ag1456, Run 148059395 | Rel. Exp. (%) Ag1456, Run 162599938 |
|---|---|---|---|---|---|---|---|
| CC Margin (OD03921) | 0.0 | 0.5 | 1.7 | Thyroid Cancer 064010 | 0.0 | 1.3 | 2.8 |
| CC from Partial Hepatectomy (OD04309) Mets | 2.3 | 6.7 | 7.1 | Thyroid Cancer A302152 | 1.9 | 0.6 | 3.0 |
| Liver Margin (OD04309) | 3.2 | 7.3 | 2.3 | Thyroid Margin A302153 | 0.0 | 0.0 | 1.9 |
| Colon mets to lung (OD04451-01) | 1.3 | 0.6 | 0.0 | Normal Breast | 0.8 | 1.9 | 0.0 |
| Lung Margin (OD04451-02 | 2.0 | 4.5 | 1.9 | Breast Cancer (OD04566) | 0.0 | 0.0 | 0.0 |
| Normal Prostate 6546-1 | 0.0 | 0.0 | 0.0 | Breast Cancer (OD04590-01) | 0.0 | 1.9 | 0.0 |
| Prostate Cancer (OD04410) | 0.7 | 0.0 | 2.9 | Breast Cancer Mets (OD04590-03) | 0.9 | 0.5 | 1.4 |
| Prostate Margin (OD04410) | 0.6 | 0.0 | 0.0 | Breast Cancer Metastasis (OD04655-05) | 1.1 | 0.6 | 1.7 |
| Prostate Cancer (OD04720-01) | 0.6 | 0.0 | 0.0 | Breast Cancer 064006 | 0.0 | 0.7 | 0.0 |
| Prostate Margin (OD04720-02) | 2.8 | 0.2 | 2.9 | Breast Cancer 1024 | 0.7 | 0.0 | 0.9 |
| Normal Lung 061010 | 7.4 | 8.2 | 0.0 | Breast Cancer 9100266 | 0.0 | 0.0 | 0.0 |
| Lung Met to Muscle (OD04286) | 6.1 | 2.0 | 5.8 | Breast Margin 9100265 | 0.7 | 0.0 | 0.0 |
| Muscle Margin (OD04286) | 1.5 | 0.6 | 1.1 | Breast Cancer A209073 | 0.8 | 0.0 | 0.0 |
| Lung Malignant Cancer (OD03126) | 9.9 | 7.3 | 4.1 | Breast Margin A2090734 | 0.0 | 0.0 | 0.0 |
| Lung Margin (OD03126) | 33.9 | 28.1 | 27.0 | Normal Liver | 0.0 | 0.0 | 1.1 |
| Lung Cancer (OD04404) | 13.3 | 11.2 | 13.0 | Liver Cancer 064003 | 1.4 | 0.0 | 0.0 |
| Lung Margin (OD04404) | 32.8 | 22.2 | 28.3 | Liver Cancer 1025 | 0.0 | 0.0 | 0.8 |
| Lung Cancer (OD04565) | 4.5 | 1.3 | 5.7 | Liver Cancer 1026 | 2.2 | 1.8 | 0.9 |
| Lung Margin (OD04565) | 0.0 | 7.2 | 4.9 | Liver Cancer 6004-T | 1.2 | 1.0 | 0.0 |
| Lung Cancer (OD04237-01) | 2.1 | 1.6 | 3.5 | Liver Tissue 6004-N | 1.1 | 0.7 | 2.7 |
| Lung Margin | 100.0 | 100.0 | 100.0 | Liver | 0.0 | 0.0 | 0.8 |

TABLE AJ-continued

Panel 2D

| Tissue Name | Rel. Exp. (%) Ag1456, Run 147644930 | Rel. Exp. (%) Ag1456, Run 148059395 | Rel. Exp. (%) Ag1456, Run 162599938 | Tissue Name | Rel. Exp. (%) Ag1456, Run 147644930 | Rel. Exp. (%) Ag1456, Run 148059395 | Rel. Exp. (%) Ag1456, Run 162599938 |
|---|---|---|---|---|---|---|---|
| (OD04237-02) Ocular Mel Met to Liver | 0.3 | 0.0 | 0.0 | Cancer 6005-T Liver Tissue | 0.0 | 0.0 | 0.6 |
| (ODO4310) Liver Margin | 1.9 | 0.6 | 0.7 | 6005-N Normal Bladder | 3.9 | 1.8 | 8.4 |
| (ODO4310) Melanoma Mets to Lung | 0.5 | 0.0 | 0.0 | Bladder Cancer 1023 | 0.0 | 0.0 | 0.0 |
| (OD04321) Lung Margin (OD04321) | 22.8 | 27.5 | 24.5 | Bladder Cancer A302173 | 3.3 | 5.2 | 1.7 |
| Normal Kidney | 0.0 | 0.6 | 1.6 | Bladder Cancer (OD04718-01) | 13.0 | 11.0 | 11.8 |
| Kidney Ca, Nuclear grade 2 (OD04338) | 8.7 | 11.5 | 16.5 | Bladder Normal Adjacent (OD04718-03) | 14.6 | 12.7 | 15.9 |
| Kidney Margin (OD04338) | 2.0 | 6.1 | 3.2 | Normal Ovary | 0.0 | 0.0 | 0.0 |
| Kidney Ca Nuclear grade 1/2 (OD04339) | 1.4 | 0.6 | 0.8 | Ovarian Cancer 064008 | 0.0 | 0.8 | 0.0 |
| Kidney Margin (OD04339) | 0.0 | 0.5 | 2.6 | Ovarian Cancer (OD04768-07) | 2.9 | 2.3 | 6.0 |
| Kidney Ca, Clear cell type (OD04340) | 20.0 | 26.8 | 25.9 | Ovary Margin (OD04768-08) | 16.7 | 20.9 | 12.9 |
| Kidney Margin (OD04340) | 7.2 | 3.4 | 9.7 | Normal Stomach | 1.1 | 3.3 | 3.2 |
| Kidney Ca, Nuclear grade 3 (OD04348) | 0.7 | 0.0 | 0.5 | Gastric Cancer 9060358 | 0.0 | 0.0 | 0.0 |
| Kidney Margin (OD04348) | 1.2 | 1.4 | 1.8 | Stomach Margin 9060359 | 3.1 | 5.9 | 3.3 |
| Kidney Cancer (OD04622-01) | 11.2 | 11.2 | 20.9 | Gastric Cancer 9060395 | 13.2 | 3.7 | 11.0 |
| Kidney Margin (OD04622-03) | 1.6 | 1.0 | 1.4 | Stomach Margin 9060394 | 1.6 | 2.7 | 4.3 |
| Kidney Cancer (OD04450-01) | 0.7 | 0.0 | 0.0 | Gastric Cancer 9060397 | 19.1 | 7.4 | 9.8 |
| Kidney Margin (OD04450-03) | 0.0 | 1.4 | 3.2 | Stomach Margin 9060396 | 0.0 | 1.2 | 0.8 |
| Kidney Cancer 8120607 | 0.0 | 0.0 | 0.0 | Gastric Cancer 064005 | 4.3 | 5.6 | 3.9 |

TABLE AK

Panel 4D

| Tissue Name | Rel. Exp. (%) Ag1456, Run 139309823 | Rel. Exp. (%) Ag1456, Run 144691235 | Rel. Exp. (%) Ag1899, Run 165870453 | Rel. Exp. (%) Ag2059, Run 161426290 | Rel. Exp. (%) Ag2132, Run 159366502 | Rel. Exp. (%) Ag2444, Run 164320874 |
|---|---|---|---|---|---|---|
| Secondary Th1 act | 0.0 | 0.0 | 0.0 | 0.0 | 0.0 | 0.0 |
| Secondary Th2 act | 0.4 | 0.4 | 0.0 | 0.0 | 0.0 | 0.0 |
| Secondary Tr1 act | 0.0 | 0.0 | 0.0 | 0.0 | 0.0 | 0.0 |
| Secondary Th1 rest | 0.0 | 0.0 | 0.3 | 0.0 | 0.0 | 0.0 |
| Secondary Th2 rest | 6.1 | 4.8 | 2.4 | 0.8 | 2.7 | 0.0 |
| Secondary Tr1 rest | 0.4 | 0.0 | 0.3 | 0.0 | 1.4 | 0.0 |
| Primary Th1 act | 0.0 | 0.7 | 0.0 | 0.0 | 0.0 | 0.0 |
| Primary Th2 act | 1.5 | 0.3 | 0.6 | 0.0 | 0.0 | 0.0 |
| Primary Tr1 act | 0.0 | 0.6 | 0.1 | 0.0 | 0.0 | 0.0 |
| Primary Th1 rest | 4.5 | 4.1 | 7.9 | 3.0 | 5.3 | 0.0 |
| Pnimary Th2 rest | 6.5 | 2.9 | 3.7 | 6.3 | 1.1 | 41.5 |
| Primary Tr1 rest | 2.7 | 3.5 | 1.6 | 2.5 | 1.0 | 0.0 |
| CD45RA CD4 lymphocyte act | 0.0 | 0.0 | 0.0 | 0.0 | 0.0 | 0.0 |
| CD45RO CD4 lymphocyte act | 0.0 | 0.4 | 0.3 | 0.0 | 0.0 | 0.0 |
| CD8 lymphocyte act | 0.0 | 0.0 | 0.0 | 0.0 | 0.0 | 0.0 |
| Secondary CD8 lymphocyte rest | 0.5 | 0.0 | 0.2 | 0.0 | 0.0 | 0.0 |
| Secondary CD8 lymphocyte act | 0.6 | 0.0 | 0.0 | 0.0 | 0.0 | 0.0 |
| CD4 lymphocyte none | 3.1 | 1.1 | 1.4 | 5.1 | 0.0 | 0.0 |
| 2ry Th1/Th2/Tr1_anti-CD95 CH11 | 4.3 | 5.9 | 4.7 | 2.1 | 3.5 | 0.0 |
| LAK cells rest | 0.5 | 1.1 | 0.5 | 0.0 | 0.0 | 0.0 |
| LAK cells IL-2 | 1.0 | 1.4 | 0.8 | 0.0 | 1.6 | 0.0 |
| LAK cells IL-2 + IL-12 | 1.0 | 0.9 | 0.2 | 0.0 | 0.0 | 0.0 |
| LAK cells IL-2 + IFN gamma | 0.5 | 2.1 | 0.6 | 0.0 | 0.0 | 0.0 |
| LAK cells IL-2 + IL-18 | 1.0 | 0.4 | 0.4 | 0.0 | 0.0 | 0.0 |
| LAK cells PMA/ionomycin | 17.1 | 17.8 | 8.0 | 8.5 | 10.0 | 0.0 |
| NK Cells IL-2 rest | 0.0 | 0.0 | 0.2 | 1.2 | 0.0 | 0.0 |
| Two Way MLR 3 day | 0.0 | 0.0 | 0.0 | 1.5 | 0.0 | 38.7 |
| Two Way MLR 5 day | 0.0 | 0.3 | 0.0 | 0.0 | 0.0 | 0.0 |
| Two Way MLR 7 day | 0.0 | 0.5 | 0.0 | 0.0 | 0.0 | 0.0 |
| PBMC rest | 20.3 | 22.2 | 18.4 | 6.7 | 14.0 | 100.0 |
| PBMC PWM | 0.5 | 0.0 | 0.0 | 0.0 | 1.3 | 45.7 |
| PBMC PHA-L | 0.0 | 1.0 | 0.2 | 0.0 | 0.0 | 0.0 |
| Ramos (B cell) none | 36.1 | 48.6 | 21.0 | 0.0 | 7.2 | 44.1 |
| Ramos (B cell) ionomycin | 100.0 | 87.1 | 16.6 | 44.1 | 27.9 | 46.7 |
| B lymphocytes PWM | 0.5 | 0.0 | 0.0 | 1.6 | 0.0 | 0.0 |
| B lymphocytes CD40L and IL-4 | 0.5 | 0.0 | 0.0 | 0.0 | 0.0 | 0.0 |
| EOL-1 dbcAMP | 0.0 | 0.0 | 0.2 | 0.0 | 0.0 | 0.0 |
| EOL-1 dbcAMP PMA/ionomycin | 0.4 | 0.0 | 0.6 | 1.1 | 1.2 | 0.0 |
| Dendritic cells none | 5.6 | 4.7 | 4.3 | 3.7 | 8.4 | 0.0 |
| Dendritic cells LPS | 3.0 | 1.8 | 2.3 | 3.7 | 1.8 | 30.1 |
| Dendritic cells anti-CD40 | 2.6 | 3.2 | 2.0 | 4.7 | 0.0 | 0.0 |
| Monocytes rest | 97.3 | 100.0 | 100.0 | 100.0 | 100.0 | 82.4 |
| Monocytes LPS | 34.2 | 34.4 | 20.3 | 15.8 | 19.3 | 32.5 |
| Macrophages rest | 5.1 | 5.5 | 3.0 | 4.0 | 1.3 | 0.0 |
| Macrophages LPS | 7.5 | 9.7 | 4.8 | 3.0 | 0.0 | 0.0 |
| HUVEC none | 0.0 | 0.0 | 0.0 | 0.0 | 0.0 | 0.0 |
| HUVEC starved | 0.0 | 0.0 | 0.0 | 0.0 | 0.0 | 0.0 |
| HUVEC IL-1beta | 0.0 | 0.0 | 0.0 | 0.0 | 0.0 | 0.0 |
| HUVEC IFN | 0.0 | 0.0 | 0.0 | 0.0 | 0.0 | 0.0 |

TABLE AK-continued

Panel 4D

| Tissue Name | Rel. Exp. (%) Ag1456, Run 139309823 | Rel. Exp. (%) Ag1456, Run 144691235 | Rel. Exp. (%) Ag1899, Run 165870453 | Rel. Exp. (%) Ag2059, Run 161426290 | Rel. Exp. (%) Ag2132, Run 159366502 | Rel. Exp. (%) Ag2444, Run 164320874 |
|---|---|---|---|---|---|---|
| gamma | | | | | | |
| HUVEC TNF alpha + IFN gamma | 0.0 | 0.0 | 0.0 | 0.0 | 0.0 | 0.0 |
| HUVEC TNF alpha + IL4 | 0.0 | 0.0 | 0.0 | 0.0 | 0.0 | 0.0 |
| HUVEC IL-11 | 0.0 | 0.0 | 0.0 | 0.0 | 0.0 | 0.0 |
| Lung Microvascular EC none | 0.0 | 0.0 | 0.0 | 0.0 | 0.0 | 0.0 |
| Lung Microvascular EC TNFalpha + IL-1beta | 0.0 | 0.0 | 0.0 | 0.0 | 0.0 | 0.0 |
| Microvascular Dermal EC none | 0.0 | 0.0 | 0.0 | 0.0 | 0.0 | 0.0 |
| Microsvasular Dermal EC TNFalpha + IL-1beta | 0.0 | 0.0 | 0.0 | 0.0 | 0.0 | 0.0 |
| Bronchial epithelium TNFalpha + IL1beta | 0.0 | 0.0 | 0.0 | 0.0 | 0.0 | 0.0 |
| Small airway epithelium none | 0.5 | 0.5 | 0.5 | 0.0 | 0.0 | 0.0 |
| Small airway epithelium TNFalpha + IL-1beta | 4.0 | 3.8 | 2.1 | 6.2 | 6.3 | 0.0 |
| Coronery artery SMC rest | 0.0 | 0.0 | 0.0 | 0.0 | 0.0 | 0.0 |
| Coronery artery SMC TNFalpha + IL-1beta | 0.0 | 0.0 | 0.0 | 0.0 | 0.0 | 0.0 |
| Astrocytes rest | 0.0 | 0.0 | 0.0 | 0.0 | 0.0 | 0.0 |
| Astrocytes TNFalpha + IL-1beta | 0.0 | 0.0 | 0.0 | 0.0 | 0.0 | 0.0 |
| KU-812 (Basophil) rest | 0.0 | 0.0 | 0.0 | 0.0 | 0.0 | 0.0 |
| KU-812 (Basophil) PMA/ionomycin | 0.0 | 0.0 | 0.0 | 0.0 | 0.0 | 0.0 |
| CCD1106 (Keratinocytes) none | 0.0 | 0.0 | 0.0 | 0.0 | 0.0 | 0.0 |
| CCD1106 (Keratinocytes) TNFalpha + IL-1beta | 0.0 | 0.4 | 0.2 | 0.0 | 0.0 | 0.0 |
| Liver cirrhosis | 5.4 | 5.4 | 6.9 | 3.0 | 1.4 | 0.0 |
| Lupus kidney | 0.4 | 0.4 | 0.9 | 0.0 | 0.0 | 0.0 |
| NCI-H292 none | 0.0 | 0.4 | 0.0 | 0.0 | 1.5 | 0.0 |
| NCI-H292 IL-4 | 0.0 | 0.0 | 0.0 | 0.0 | 0.0 | 0.0 |
| NCI-H292 IL-9 | 0.0 | 0.0 | 0.3 | 0.0 | 0.0 | 0.0 |
| NCI-H292 IL-13 | 0.0 | 0.0 | 0.0 | 0.0 | 0.0 | 0.0 |
| NCI-H292 IFN gamma | 0.0 | 0.0 | 0.0 | 0.0 | 0.0 | 0.0 |
| HPAEC none | 0.0 | 0.0 | 0.0 | 0.0 | 0.0 | 0.0 |
| HPAEC TNFalpha + IL-1beta | 0.0 | 0.0 | 0.0 | 0.0 | 0.0 | 0.0 |
| Lung fibroblast | 0.0 | 0.0 | 0.0 | 0.0 | 0.0 | 0.0 |

TABLE AK-continued

Panel 4D

| Tissue Name | Rel. Exp. (%) Ag1456, Run 139309823 | Rel. Exp. (%) Ag1456, Run 144691235 | Rel. Exp. (%) Ag1899, Run 165870453 | Rel. Exp. (%) Ag2059, Run 161426290 | Rel. Exp. (%) Ag2132, Run 159366502 | Rel. Exp. (%) Ag2444, Run 164320874 |
|---|---|---|---|---|---|---|
| none | | | | | | |
| Lung fibroblast TNFalpha + IL-1beta | 0.0 | 0.0 | 0.0 | 0.0 | 0.0 | 27.0 |
| Lung fibroblast IL-4 | 0.0 | 0.0 | 0.0 | 0.0 | 0.0 | 0.0 |
| Lung fibroblast IL-9 | 0.0 | 0.0 | 0.0 | 0.0 | 0.0 | 0.0 |
| Lung fibroblast IL-13 | 0.0 | 0.0 | 0.0 | 0.0 | 0.0 | 0.0 |
| Lung fibroblast IFN gamma | 0.0 | 0.0 | 0.0 | 0.0 | 0.0 | 0.0 |
| Dermal fibroblast CCD1070 rest | 0.0 | 0.0 | 0.0 | 0.0 | 0.0 | 0.0 |
| Dermal fibroblast CCD1070 TNF alpha | 1.6 | 0.0 | 0.2 | 0.0 | 0.0 | 0.0 |
| Dermal fibroblast CCD1070 IL-1beta | 0.0 | 0.0 | 0.0 | 0.0 | 0.0 | 0.0 |
| Dermal fibroblast IFN gamma | 0.0 | 0.0 | 0.1 | 0.0 | 0.0 | 0.0 |
| Dermal fibroblast IL-4 | 0.5 | 0.0 | 0.0 | 0.0 | 0.0 | 0.0 |
| IBD Colitis 2 | 0.6 | 0.0 | 1.4 | 0.0 | 0.0 | 0.0 |
| IBD Crohn's | 1.4 | 1.5 | 2.0 | 0.0 | 0.0 | 0.0 |
| Colon | 0.6 | 0.0 | 0.6 | 0.0 | 3.1 | 0.0 |
| Lung | 3.7 | 5.2 | 1.5 | 2.1 | 4.9 | 0.0 |
| Thymus | 0.5 | 0.0 | 0.2 | 0.0 | 0.0 | 0.0 |
| Kidney | 2.6 | 4.4 | 0.6 | 1.6 | 0.0 | 0.0 |

AI_comprehensive panel_v1.0 Summary: Ag 1456 Highest expression of the sggc_draft ba186014_20000730_da1 transcript is found in normal colon tissue adjacent to tissue affected by Crohn's or ulcerative colitis (CTs=33). This transcript is also found in normal colon on panels 1.2 and 2D. Since this transcript appears to be down regulated in diseased colon, therapeutic modulation of the expression or function of the this gene or its protein product, through the use protein therapeutics, could regulate normal homeostasis of this tissue and be beneficial for the treatment of inflammatory bowel diseases.

CNS_neurodegeneration_v1.0 Summary: Ag2446 Expression of the sggc_draft_ba186014_20000730_da1 gene is low/undetectable in all samples on this panel. (CTs>35). The amp plot indicates that there may have been a probe failure in this experiment. (Data not shown.)

Panel 1.2 Summary: Ag1456 Highest expression of the sggc_draft_ba186014_20000730_da1 gene is detected in bone marrow (CT=28.9). Furthermore, the difference in expression between heart (CT=31.2) and fetal heart tissue (CT=36.2) is significant in this panel. Thus, the expression of this gene could be used to distinguish bone marrow from the other samples in the panel. In addition, the expression of this gene could be used to distinguish adult heart tissue from fetal heart tissue.

The sggc_draft_ba186014_20000730_da1 gene is also expressed in many tissues with metabolic function, including the heart, fetal and adult liver, skeletal muscle and adrenal gland. The protein encoded by the sggc_draft_ba186014_20000730_da1 gene is a lipase homolog and may be involved in the dynamic mobilization of fat in these tissues. Therefore, administration of this gene product or an agonist designed to it could enhance lipolysis and may act as an effective therapy against obesity and lipodystrophy. Conversely, an antagonist of this gene product may be useful in the treatment of conditions involving excessive depletion of fat reserves, such as cachexia.

Panel 1.3D Summary: Ag1456/Ag2132/Ag2444 Three out of four experiments using different probe and primer sets show expression of the sggc_draft_ba186014_20000730_da1 gene in bone marrow (CTs=33–34) and the lung (CT=32.4). The high expression in bone marrow is consistent with its expression seen in Panel 1.2. Thus, the expression of this gene could be used to distinguish samples derived from bone marrow and lung from other tissues on this panel. Furthermore, expression of the sggc_draft_ba186014_20000730_da1 gene could be used to distinguish between adult and fetal lung tissue.

Ag2059/Ag2446 Expression of the gene is low/undetectable (Ct values>35) in all samples in Panel 1.3D (data not shown).

Panel 2D Summary: Ag1456 Three experiments with the same probe and primer produce results that are in excellent agreement, with highest expression of the sggc_draft_ba186014_20000730_da1 gene in normal lung tissue adjacent to a tumor (CTs=30–31). In addition, the sggc_draft_ba186014_20000730_da1 gene appears to be overexpressed in three pairs of normal lung tissue when compared to corresponding cancerous tissue. In addition, four of nine kidney cancers show overexpression of this gene when compared to their respective normal adjacent tissue. Thus, the expression of this gene could be used to distinguish normal lung tissue from malignant lung tissue as well as malignant kidney from normal kidney. Moreover, therapeutic modulation of the expression of the sggc_draft_ba186014_20000730_da1 gene or its gene product, through the use of small molecule drugs, antibodies or protein therapeutics may be effective in the treatment of kidney cancer or lung cancer.

Panel 4D Summary: Ag1456/Ag1899/Ag2059/Ag2132 Multiple experiments with different probe and primer sets show highest expression of the sggc_draft_ba186014_20000730_da1 gene in resting monocytes (CTs=29–32). The gene appears to be downregulated in these cells following LPS treatment (CTs=32–34) and is not expressed at detectable levels in macrophages. The protein encoded by sggc_draft_ba186014_20000730_da1 gene is homologous to acidic lipases and may play a role in lipid metabolism, differentiation, and activities such as phagocytosis, of these cells. Therefore, therapeutic modulation of the expression or function of the sggc_draft_ba186014_20000730_da1 gene or its protein product, through the use protein therapeutics, could regulate monocyte function and/or differentiation.

Conversely, modulation of the expression or activity of the putative protein encoded by this transcript by antibodies or small molecules can reduce or prevent the inflammatory symptoms associated with accumulation of monocytes observed in diseases such as asthma, allergies, inflammatory bowel disease, lupus erythematosus, or rheumatoid arthritis.

B. CG51493-01/20708613_EXT1: MEGF/Flamingo/Cadherin-Like (NOV2)

Expression of gene CG51493-01 was assessed using the primer-probe set Ag1988, described in Table BA. Results of the RTQ-PCR runs are shown in Tables BB, BC, BD, BE, BF and BG.

TABLE BB

CNS_neurodegeneration_v1.0

| Tissue Name | Rel. Exp. (%) Ag1988, Run 207794916 | Tissue Name | Rel. Exp. (%) Ag1988, Run 207794916 |
|---|---|---|---|
| AD 1 Hippo | 9.9 | Control (Path) 3 Temporal Ctx | 5.5 |
| AD 2 Hippo | 23.8 | Control (Path) 4 Temporal Ctx | 28.7 |
| AD 3 Hippo | 7.2 | AD 1 Occipital Ctx | 10.0 |
| AD 4 Hippo | 6.7 | AD 2 Occipital Ctx (Missing) | 0.0 |
| AD 5 Hippo | 100.0 | AD 3 Occipital Ctx | 5.8 |
| AD 6 Hippo | 32.3 | AD 4 Occipital Ctx | 24.5 |
| Control 2 Hippo | 27.7 | AD 5 Occipital Ctx | 50.7 |
| Control 4 Hippo | 5.7 | AD 6 Occipital Ctx | 17.9 |
| Control (Path) 3 Hippo | 3.5 | Control 1 Occipital Ctx | 2.0 |
| AD 1 Temporal Ctx | 19.2 | Control 2 Occipital Ctx | 75.8 |
| AD 2 Temporal Ctx | 28.3 | Control 3 Occipital Ctx | 16.7 |
| AD 3 Temporal Ctx | 7.5 | Control 4 Occipital Ctx | 3.0 |
| AD 4 Temporal Ctx | 17.2 | Control (Path) 1 Occipital Ctx | 90.1 |
| AD 5 Inf Temporal Ctx | 92.7 | Control (Path) 2 Occipital Ctx | 8.7 |
| AD 5 Sup Temporal Ctx | 28.5 | Control (Path) 3 Occipital Ctx | 2.2 |
| AD 6 Inf Temporal Ctx | 37.6 | Control (Path) 4 Occipital Ctx | 14.7 |
| AD 6 Sup Temporal Ctx | 44.4 | Control 1 Parietal Ctx | 3.2 |
| Control 1 Temporal Ctx | 3.6 | Control 2 Parietal Ctx | 34.9 |
| Control 2 Temporal Ctx | 44.8 | Control 3 Parietal Ctx | 15.3 |
| Control 3 Temporal Ctx | 10.3 | Control (Path) 1 Parietal Ctx | 90.1 |
| Control 3 Temporal Ctx | 7.1 | Control (Path) 2 Parietal Ctx | 15.4 |
| Control (Path) 1 Temporal Ctx | 74.7 | Control (Path) 3 Parietal Ctx | 3.3 |
| Control (Path) 2 Temporal Ctx | 31.6 | Control (Path) 4 Parietal Ctx | 44.1 |

TABLE BA

Probe Name Ag1988

| Primers | Sequences | Start Position | SEQ ID NO |
|---|---|---|---|
| Forward | 5'-tcactgctatgtgcacatcaa-3' | 2517 | 278 |
| Probe | TET-5'-catcacagatgccaacactcatcgg-3'-TAMRA | 2538 | 279 |
| Reverse | 5'-actgagtagtgggcactttgaa-3' | 2570 | 280 |

TABLE BC

Panel 1.3D

| Tissue Name | Rel. Exp. (%) Ag1988, Run 147796787 | Rel. Exp. (%) Ag1988, Run 148015671 | Tissue Name | Rel. Exp. (%) Ag1988, Run 147796787 | Rel. Exp. (%) Ag1988, Run 148015671 |
|---|---|---|---|---|---|
| Liver adenocarcinoma | 7.3 | 11.6 | Kidney (fetal) | 0.4 | 0.1 |
| Pancreas | 0.2 | 1.1 | Renal ca. 786-0 | 1.0 | 2.5 |
| Pancreatic ca. CAPAN 2 | 2.9 | 8.0 | Renal ca. A498 | 16.5 | 21.0 |
| Adrenal gland | 0.6 | 0.7 | Renal ca. RXF 393 | 0.5 | 0.7 |
| Thyroid | 0.0 | 0.1 | Renal ca. ACHN | 18.0 | 17.8 |
| Salivary gland | 0.0 | 0.1 | Renal ca. UO-31 | 2.8 | 4.2 |
| Pituitary gland | 15.9 | 17.1 | Renal ca. TK-10 | 7.3 | 16.5 |
| Brain (fetal) | 15.2 | 17.2 | Liver | 0.0 | 0.0 |
| Brain (whole) | 13.6 | 22.4 | Liver (fetal) | 0.0 | 0.4 |
| Brain (amygdala) | 9.5 | 15.7 | Liver ca. (hepatoblast) HepG2 | 11.6 | 18.9 |
| Brain (cerebellum) | 11.0 | 17.8 | Lung | 1.3 | 0.0 |
| Brain (hippocampus) | 15.1 | 29.9 | Lung (fetal) | 0.2 | 0.0 |
| Brain (substantia nigra) | 0.5 | 1.3 | Lung ca. (small cell) LX-1 | 25.0 | 33.2 |
| Brain (thalamus) | 6.6 | 10.0 | Lung ca. (small cell) NCI-H69 | 36.9 | 62.4 |
| Cerebral Cortex | 100.0 | 100.0 | Lung ca. (s. cell var.) SHP-77 | 32.8 | 46.3 |
| Spinal cord | 1.5 | 1.4 | Lung ca. (large cell) NCI-H460 | 0.0 | 1.4 |
| glio/astro U87-MG | 11.7 | 19.9 | Lung ca. (non-sm. cell) A549 | 3.4 | 6.9 |
| glio/astro U-118-MG | 51.1 | 77.9 | Lung ca. (non-s. cell) NCI-H23 | 26.8 | 43.5 |
| astrocytoma SW1783 | 2.1 | 5.1 | Lung ca. (non-s. cell) HOP-62 | 5.9 | 11.7 |
| neuro*; met SK-N-AS | 30.6 | 37.1 | Lung ca. (non-s. cl) NCI-H522 | 12.0 | 26.2 |
| astrocytoma SF-539 | 3.9 | 7.9 | Lung ca. (squam.) SW 900 | 9.4 | 18.0 |
| astrocytoma SNB-75 | 58.2 | 82.4 | Lung ca. (squam.) NCI-H596 | 17.6 | 25.2 |
| glioma SNB-19 | 5.4 | 5.0 | Mammary gland | 0.4 | 0.6 |
| glioma U251 | 3.0 | 3.7 | Breast ca.* (pl. ef) MCF-7 | 4.4 | 6.2 |
| glioma SF-295 | 30.4 | 44.4 | Breast ca.* (pl. ef) MDA-MB-231 | 7.4 | 8.2 |
| Heart (fetal) | 0.8 | 0.5 | Breast ca.* (pl. ef) T47D | 21.9 | 30.1 |
| Heart | 0.0 | 0.0 | Breast ca. BT-549 | 14.1 | 14.1 |
| Skeletal muscle (fetal) | 0.9 | 2.2 | Breast ca. MDA-N | 14.2 | 17.4 |
| Skeletal muscle | 0.0 | 0.0 | Ovary | 0.8 | 0.8 |
| Bone marrow | 0.0 | 0.0 | Ovarian ca. OVCAR-3 | 2.6 | 4.2 |
| Thymus | 0.1 | 0.2 | Ovarian ca. OVCAR-4 | 0.4 | 1.2 |
| Spleen | 0.1 | 0.4 | Ovarian ca. OVCAR-5 | 7.0 | 8.2 |
| Lymph node | 0.4 | 0.7 | Ovarian ca. OVCAR-8 | 33.7 | 59.9 |
| Colorectal | 1.4 | 1.5 | Ovarian ca. IGROV-1 | 0.4 | 1.1 |
| Stomach | 0.0 | 1.2 | Ovarian ca.* | 0.4 | 0.7 |

TABLE BC-continued

Panel 1.3D

| Tissue Name | Rel. Exp. (%) Ag1988, Run 147796787 | Rel. Exp. (%) Ag1988, Run 148015671 | Tissue Name | Rel. Exp. (%) Ag1988, Run 147796787 | Rel. Exp. (%) Ag1988, Run 148015671 |
|---|---|---|---|---|---|
| | | | (ascites) SK-OV-3 | | |
| Small intestine | 0.2 | 0.3 | Uterus | 0.1 | 0.2 |
| Colon ca. SW480 | 31.9 | 45.7 | Placenta | 0.7 | 1.1 |
| Colon ca.* SW620(SW480 met) | 11.0 | 18.7 | Prostate | 0.0 | 0.0 |
| Colon ca. HT29 | 5.2 | 10.6 | Prostate ca.* (bone met) PC-3 | 2.0 | 5.1 |
| Colon ca. HCT-116 | 0.8 | 2.8 | Testis | 4.5 | 5.6 |
| Colon ca. CaCo-2 | 40.1 | 51.4 | Melanoma Hs668(A).T | 1.5 | 3.9 |
| Colon ca. tissue(ODO3866) | 7.7 | 10.2 | Melanoma* (met) Hs688(B).T | 3.3 | 5.5 |
| Colon ca. HCC-2998 | 32.3 | 27.5 | Melanoma UACC-62 | 0.1 | 5.0 |
| Gastric ca.* (liver met) NCI-N87 | 5.9 | 8.0 | Melanoma M14 | 2.5 | 4.8 |
| Bladder | 0.3 | 0.6 | Melanoma LOX IMVI | 3.6 | 11.3 |
| Trachea | 0.0 | 0.4 | Melanoma* (met)SK-MEL-5 | 3.8 | 5.8 |
| Kidney | 0.0 | 0.1 | Adipose | 0.2 | 0.3 |

TABLE BD

Panel 2D

| Tissue Name | Rel. Exp. (%) Ag1988, Run 148015699 | Rel. Exp. (%) Ag1988, Run 151268165 | Tissue Name | Rel. Exp. (%) Ag1988, Run 148015699 | Rel. Exp. (%) Ag1988, Run 151268165 |
|---|---|---|---|---|---|
| Normal Colon | 5.1 | 7.6 | Kidney Margin 8120608 | 0.4 | 0.5 |
| CC Well to Mod Diff (ODO3866) | 12.7 | 12.5 | Kidney Cancer 8120613 | 1.4 | 1.1 |
| CC Margin (ODO3866) | 0.7 | 2.0 | Kidney Margin 8120614 | 1.6 | 1.2 |
| CC Gr.2 rectosigmoid (ODO3868) | 7.1 | 8.1 | Kidney Cancer 9010320 | 2.5 | 1.1 |
| CC Margin (ODO3868) | 0.6 | 0.4 | Kidney Margin 9010321 | 1.1 | 1.8 |
| CC Mod Diff (ODO3920) | 11.0 | 7.9 | Normal Uterus | 1.7 | 0.0 |
| CC Margin (ODO3920) | 6.0 | 2.8 | Uterus Cancer 064011 | 3.2 | 3.3 |
| CC Gr.2 ascend colon (ODO3921) | 40.1 | 25.7 | Normal Thyroid | 0.2 | 0.5 |
| CC Margin (ODO3921) | 0.8 | 0.5 | Thyroid Cancer 064010 | 2.3 | 2.1 |
| CC from Partial Hepatectomy (ODO4309) Mets | 1.4 | 1.3 | Thyroid Cancer A302152 | 2.0 | 1.1 |
| Liver Margin (ODO4309) | 0.2 | 0.5 | Thyroid Margin A302153 | 2.5 | 1.0 |
| Colon mets to lung (OD04451-01) | 14.5 | 11.8 | Normal Breast | 4.1 | 3.5 |
| Lung Margin | 2.1 | 3.4 | Breast Cancer | 5.7 | 3.2 |

TABLE BD-continued

Panel 2D

| Tissue Name | Rel. Exp. (%) Ag1988, Run 148015699 | Rel. Exp. (%) Ag1988, Run 151268165 | Tissue Name | Rel. Exp. (%) Ag1988, Run 148015699 | Rel. Exp. (%) Ag1988, Run 151268165 |
|---|---|---|---|---|---|
| (OD04451-02) | | | (OD04566) | | |
| Normal Prostate 6546-1 | 0.9 | 0.6 | Breast Cancer (OD04590-01) | 100.0 | 100.0 |
| Prostate Cancer (OD04410) | 2.6 | 2.4 | Breast Cancer Mets (OD04590-03) | 63.7 | 56.3 |
| Prostate Margin (OD04410) | 1.7 | 2.0 | Breast Cancer Metastasis (OD04655-05) | 50.7 | 47.0 |
| Prostate Cancer (OD04720-01) | 1.6 | 2.2 | Breast Cancer 064006 | 3.6 | 3.4 |
| Prostate Margin (OD04720-02) | 1.2 | 2.7 | Breast Cancer 1024 | 4.0 | 7.1 |
| Normal Lung 061010 | 1.3 | 1.4 | Breast Cancer 9100266 | 26.2 | 27.2 |
| Lung Met to Muscle (ODO4286) | 5.7 | 4.7 | Breast Margin 9100265 | 10.4 | 7.4 |
| Muscle Margin (ODO4286) | 0.2 | 1.0 | Breast Cancer A209073 | 6.4 | 6.6 |
| Lung Malignant Cancer (OD03126) | 28.1 | 19.2 | Breast Margin A2090734 | 2.4 | 3.4 |
| Lung Margin (OD03126) | 2.1 | 1.1 | Normal Liver | 0.4 | 0.3 |
| Lung Cancer (OD04404) | 2.9 | 1.4 | Liver Cancer 064003 | 9.3 | 8.0 |
| Lung Margin (OD04404) | 0.8 | 0.7 | Liver Cancer 1025 | 1.1 | 0.4 |
| Lung Cancer (OD04565) | 1.6 | 1.5 | Liver Cancer 1026 | 1.6 | 1.0 |
| Lung Margin (OD04565) | 2.3 | 1.1 | Liver Cancer 6004-T | 0.9 | 0.5 |
| Lung Cancer (OD04237-01) | 12.9 | 10.8 | Liver Tissue 6004-N | 2.7 | 3.2 |
| Lung Margin (OD04237-02) | 1.7 | 0.9 | Liver Cancer 6005-T | 0.5 | 1.5 |
| Ocular Mel Met to Liver (ODO4310) | 0.7 | 0.6 | Liver Tissue 6005-N | 0.0 | 0.3 |
| Liver Margin (ODO4310) | 0.0 | 1.0 | Normal Bladder | 3.2 | 3.7 |
| Melanoma Mets to Lung (OD04321) | 25.0 | 16.2 | Bladder Cancer 1023 | 6.2 | 3.9 |
| Lung Margin (OD04321) | 1.3 | 0.2 | Bladder Cancer A302173 | 9.3 | 6.1 |
| Normal Kidney | 2.3 | 0.9 | Bladder Cancer (OD04718-01) | 58.6 | 41.2 |
| Kidney Ca, Nuclear grade 2 (OD04338) | 9.7 | 5.6 | Bladder Normal Adjacent (OD04718-03) | 2.6 | 0.4 |
| Kidney Margin (OD04338) | 0.8 | 1.4 | Normal Ovary | 1.2 | 0.5 |
| Kidney Ca Nuclear grade 1/2 (OD04339) | 1.3 | 1.4 | Ovarian Cancer 064008 | 1.7 | 3.6 |
| Kidney Margin (OD04339) | 2.0 | 0.5 | Ovarian Cancer (OD04768-07) | 14.1 | 8.4 |
| Kidney Ca, Clear cell type (OD04340) | 1.5 | 0.9 | Ovary Margin (OD04768-08) | 1.3 | 0.6 |
| Kidney Margin (OD04340) | 0.8 | 2.5 | Normal Stomach | 2.6 | 3.5 |
| Kidney Ca, Nuclear grade 3 (OD04348) | 1.0 | 0.4 | Gastric Cancer 9060358 | 2.4 | 2.2 |
| Kidney Margin (OD04348) | 1.1 | 1.4 | Stomach Margin | 1.9 | 0.8 |

TABLE BD-continued

Panel 2D

| Tissue Name | Rel. Exp. (%) Ag1988, Run 148015699 | Rel. Exp. (%) Ag1988, Run 151268165 | Tissue Name | Rel. Exp. (%) Ag1988, Run 148015699 | Rel. Exp. (%) Ag1988, Run 151268165 |
|---|---|---|---|---|---|
| Kidney Cancer (OD04622-01) | 0.5 | 0.5 | Gastric Cancer 9060359 9060395 | 18.3 | 17.7 |
| Kidney Margin (OD04622-03) | 0.0 | 0.2 | Stomach Margin 9060394 | 6.9 | 3.7 |
| Kidney Cancer (OD04450-01) | 6.0 | 4.5 | Gastric Cancer 9060397 | 11.0 | 12.7 |
| Kidney Margin (OD04450-03) | 1.0 | 0.8 | Stomach Margin 9060396 | 0.5 | 0.6 |
| Kidney Cancer 8120607 | 2.2 | 3.8 | Gastric Cancer 064005 | 22.2 | 15.5 |

TABLE BE

Panel 3D

| Tissue Name | Rel. Exp. (%) Ag1988, Run 170745547 | Tissue Name | Rel. Exp. (%) Ag1988, Run 170745547 |
|---|---|---|---|
| Daoy-Medulloblastoma | 0.6 | Ca Ski-Cervical epidermoid carcinoma (metastasis) | 7.0 |
| TE671-Medulloblastoma | 0.7 | ES-2-Ovarian clear cell carcinoma | 0.5 |
| D283 Med-Medulloblastoma | 3.3 | Ramos-Stimulated with PMA/ionomycin 6 h | 0.9 |
| PFSK-1-Primitive Neuroectodermal | 0.7 | Ramos-Stimulated with PMA/ionomycin 14 h | 0.3 |
| XF-498-CNS | 1.8 | MEG-01-Chronic myelogenous leukemia (megokaryoblast) | 0.3 |
| SNB-78-Glioma | 1.1 | Raji-Burkitt's lymphoma | 0.5 |
| SF-268-Glioblastoma | 1.6 | Daudi-Burkitt's lymphoma | 0.4 |
| T98G-Glioblastoma | 5.8 | U266-B-cell plasmacytoma | 1.6 |
| SK-N-SH-Neuroblastoma (metastasis) | 4.8 | CA46-Burkitt's lymphoma | 0.0 |
| SF-295-Glioblastoma | 3.0 | RL-non-Hodgkin's B-cell lymphoma | 0.0 |
| Cerebellum | 8.1 | JM1-pre-B-cell lymphoma | 0.0 |
| Cerebellum | 5.4 | Jurkat-T cell leukemia | 0.2 |
| NCI-H292-Mucoepidermoid lung carcinoma | 4.0 | TF-1-Erythroleukemia | 1.3 |
| DMS-114-Small cell lung cancer | 6.4 | HUT 78-T-cell lymphoma | 2.8 |
| DMS-79-Small cell lung cancer | 100.0 | U937-Histiocytic lymphoma | 0.2 |
| NCI-H146-Small cell lung cancer | 13.2 | KU-812-Myelogenous leukemia | 0.1 |
| NCI-H526-Small cell lung cancer | 17.0 | 769-P-Clear cell renal carcinoma | 0.1 |
| NCI-N417-Small cell lung cancer | 4.3 | Caki-2-Clear cell renal carcinoma | 0.3 |
| NCI-H82-Small cell lung cancer | 2.3 | SW 839-Clear cell renal carcinoma | 0.0 |
| NCI-H157-Squamous cell lung cancer (metastasis) | 1.4 | G401-Wilms' tumor | 0.5 |
| NCI-H1155-Large cell lung cancer | 17.3 | Hs766T-Pancreatic carcinoma (LN metastasis) | 3.0 |
| NCI-H1299-Large cell lung cancer | 3.7 | CAPAN-1-Pancreatic adenocarcinoma (liver metastasis) | 1.7 |
| NCI-H727-Lung carcinoid | 3.9 | SU86.86-Pancreatic carcinoma (liver metastasis) | 0.4 |
| NCI-UMC-11-Lung carcinoid | 7.8 | BxPC-3-Pancreatic adenocarcinoma | 2.2 |
| LX-1-Small cell lung cancer | 5.6 | HPAC-Pancreatic adenocarcinoma | 3.5 |
| Colo-205-Colon cancer | 0.6 | MIA PaCa-2-Pancreatic carcinoma | 0.4 |
| KM12-Colon cancer | 0.9 | CFPAC-1-Pancreatic ductal adenocarcinoma | 0.4 |
| KM20L2-Colon cancer | 1.2 | PANC-1-Pancreatic epithelioid ductal carcinoma | 1.6 |
| NCI-H716-Colon cancer | 21.8 | T24-Bladder carcinma (transitional cell) | 2.0 |
| SW-48-Colon adenocarcinoma | 0.9 | 5637-Bladder carcinoma | 1.8 |
| SW1116-Colon adenocarcinoma | 0.3 | HT-1197-Bladder carcinoma | 0.0 |
| LS 174T-Colon adenocarcinoma | 0.8 | UM-UC-3-Bladder carcinoma (transitional cell) | 0.3 |
| SW-948-Colon adenocarcinoma | 0.0 | A204-Rhabdomyosarcoma | 4.8 |
| SW-480-Colon adenocarcinoma | 1.6 | HT-1080-Fibrosarcoma | 1.6 |
| NCI-SNU-5-Gastric carcinoma | 2.2 | MG-63-Osteosarcoma | 0.1 |
| KATO III-Gastric carcinoma | 5.3 | SK-LMS-1-Leiomyosarcoma (vulva) | 8.5 |
| NCI-SNU-16-Gastric carcinoma | 0.2 | SJRH30-Rhabdomyosarcoma (met to bone marrow) | 0.5 |
| NCI-SNU-1-Gastric carcinoma | 4.2 | A431-Epidermoid carcinoma | 0.0 |
| RF-1-Gastric adenocarcinoma | 0.0 | WM266-4-Melanoma | 3.3 |

TABLE BE-continued

Panel 3D

| Tissue Name | Rel. Exp. (%) Ag1988, Run 170745547 | Tissue Name | Rel. Exp. (%) Ag1988, Run 170745547 |
|---|---|---|---|
| RF-48-Gastric adenocarcinoma | 0.3 | DU 145-Prostate carcinoma (brain metastasis) | 0.0 |
| MKN-45-Gastric carcinoma | 5.8 | MDA-MB-468-Breast adenocarcinoma | 0.0 |
| NCI-N87-Gastric carcinoma | 0.2 | SCC-4-Squamous cell carcinoma of tongue | 0.0 |
| OVCAR-5-Ovarian carcinoma | 0.0 | SCC-9-Squamous cell carcinoma of tongue | 0.0 |
| RL95-2-Uterine carcinoma | 0.5 | SCC-15-Squamous cell carcinoma of tongue | 0.0 |
| HelaS3-Cervical adenocarcinoma | 1.5 | CAL 27-Squamous cell carcinoma of tongue | 0.1 |

TABLE BF

Panel 4D

| Tissue Name | Rel. Exp. (%) Ag1988, Run 152701692 | Tissue Name | Rel. Exp. (%) Ag1988, Run 152701692 |
|---|---|---|---|
| Secondary Th1 act | 2.1 | HUVEC IL-1beta | 0.0 |
| Secondary Th2 act | 3.6 | HUVEC IFN gamma | 0.0 |
| Secondary Tr1 act | 3.3 | HUVEC TNF alpha + IFN gamma | 0.3 |
| Secondary Th1 rest | 1.0 | HUVEC TNF alpha + IL4 | 1.2 |
| Secondary Th2 rest | 0.2 | HUVEC IL-11 | 0.0 |
| Secondary Tr1 rest | 0.4 | Lung Microvascular EC none | 1.9 |
| Primary Th1 act | 5.8 | Lung Microvascular EC TNFalpha + IL-1beta | 1.5 |
| Primary Th2 act | 10.4 | Microvascular Dermal EC none | 0.8 |
| Primary Tr1 act | 4.5 | Microvascular Dermal EC TNFalpha + IL-1beta | 1.6 |
| Primary Th1 rest | 3.3 | Bronchial epithelium TNFalpha + IL1beta | 0.4 |
| Primary Th2 rest | 1.1 | Small airway epithelium none | 0.0 |
| Primary Tr1 rest | 2.1 | Small airway epithelium TNFalpha + IL-1beta | 7.4 |
| CD45RA CD4 lymphocyte act | 2.2 | Coronery artery SMC rest | 3.4 |
| CD45RO CD4 lymphocyte act | 2.3 | Coronery artery SMC TNFalpha + IL-1beta | 1.4 |
| CD8 lymphocyte act | 3.7 | Astrocytes rest | 7.6 |
| Secondary CD8 lymphocyte rest | 1.7 | Astrocytes TNFalpha + IL-1beta | 2.3 |
| Secondary CD8 lymphocyte act | 3.7 | KU-812 (Basophil) rest | 1.7 |
| CD4 lymphocyte none | 1.4 | KU-812 (Basophil) PMA/ionomycin | 6.0 |
| 2ry Th1/Th2/Tr1_anti-CD95 CH11 | 2.0 | CCD1106 (Keratinocytes) none | 9.5 |
| LAK cells rest | 0.8 | CCD1106 (Keratinocytes) TNFalpha + IL-1beta | 2.4 |
| LAK cells IL-2 | 3.9 | Liver cirrhosis | 1.1 |
| LAK cells IL-2 + IL-12 | 2.2 | Lupus kidney | 0.0 |

TABLE BF-continued

Panel 4D

| Tissue Name | Rel. Exp. (%) Ag1988, Run 152701692 | Tissue Name | Rel. Exp. (%) Ag1988, Run 152701692 |
|---|---|---|---|
| LAK cells IL-2 + IFN gamma | 5.9 | NCI-H292 none | 65.5 |
| LAK cells IL-2 + IL-18 | 5.4 | NCI-H292 IL-4 | 92.7 |
| LAK cells PMA/ionomycin | 2.6 | NCI-H292 IL-9 | 100.0 |
| NK Cells IL-2 rest | 2.7 | NCI-H292 IL-13 | 53.2 |
| Two Way MLR 3 day | 1.8 | NCI-H292 IFN gamma | 48.0 |
| Two Way MLR 5 day | 1.6 | HPAEC none | 0.0 |
| Two Way MLR 7 day | 3.4 | HPAEC TNF alpha + IL-1 beta | 1.1 |
| PBMC rest | 1.5 | Lung fibroblast none | 3.7 |
| PBMC PWM | 4.4 | Lung fibroblast TNF alpha + IL-1beta | 2.7 |
| PBMC PHA-L | 2.3 | Lung fibroblast IL-4 | 7.6 |
| Ramos (B cell) none | 18.3 | Lung fibroblast IL-9 | 3.7 |
| Ramos (B cell) ionomycin | 88.3 | Lung fibroblast IL-13 | 3.2 |
| B lymphocytes PWM | 14.1 | Lung fibroblast IFN gamma | 3.9 |
| B lymphocytes CD40L and IL-4 | 3.6 | Dermal fibroblast CCD1070 rest | 3.1 |
| EOL-1 dbcAMP | 16.7 | Dermal fibroblast CCD1070 TNF alpha | 8.0 |
| EOL-1 dbcAMP PMA/ionomycin | 13.0 | Dermal fibroblast CCD1070 IL-1beta | 5.9 |
| Dendritic cells none | 1.0 | Dermal fibroblast IFN gamma | 1.2 |
| Dendritic cells LPS | 0.3 | Dermal fibroblast IL-4 | 1.9 |
| Dendritic cells anti-CD40 | 1.0 | IBD Colitis 2 | 0.1 |
| Monocytes rest | 1.1 | IBD Crohn's | 0.0 |
| Monocytes LPS | 1.1 | Colon | 6.4 |
| Macrophages rest | 0.8 | Lung | 3.7 |
| Macrophages LPS | 0.0 | Thymus | 1.2 |
| HUVEC none | 0.2 | Kidney | 1.9 |
| HUVEC starved | 0.4 | | |

TABLE BG

Panel CNS_1

| Tissue Name | Rel. Exp. (%) Ag1988, Run 171628544 | Tissue Name | Rel. Exp. (%) Ag1988, Run 171628544 |
|---|---|---|---|
| BA4 Control | 18.7 | BA17 PSP | 25.5 |
| BA4 Control2 | 40.3 | BA17 PSP2 | 16.6 |
| BA4 Alzheimer's2 | 11.9 | Sub Nigra Control | 11.3 |
| BA4 Parkinson's | 34.4 | Sub Nigra Control2 | 17.1 |
| BA4 Parkinson's2 | 84.1 | Sub Nigra Alzheimer's2 | 6.1 |
| BA4 Huntington's | 26.1 | Sub Nigra Parkinson's2 | 23.3 |
| BA4 Huntington's2 | 12.7 | Sub Nigra Huntington's | 34.2 |
| BA4 PSP | 4.7 | Sub Nigra Huntington's2 | 17.1 |
| BA4 PSP2 | 15.9 | Sub Nigra PSP2 | 5.1 |
| BA4 Depression | 23.2 | Sub Nigra Depression | 2.1 |
| BA4 Depression2 | 4.7 | Sub Nigra Depression2 | 7.7 |
| BA7 Control | 61.6 | Glob Palladus Control | 6.8 |

TABLE BG-continued

Panel CNS_1

| Tissue Name | Rel. Exp. (%) Ag1988, Run 171628544 | Tissue Name | Rel. Exp. (%) Ag1988, Run 171628544 |
|---|---|---|---|
| BA7 Control2 | 26.2 | Glob Palladus Control2 | 6.1 |
| BA7 Alzheimer's2 | 13.3 | Glob Palladus Alzheimer's | 8.8 |
| BA7 Parkinson's | 18.8 | Glob Palladus Alzheimer's2 | 3.8 |
| BA7 Parkinson's2 | 62.9 | Glob Palladus Parkinson's | 57.4 |
| BA7 Huntington's | 66.9 | Glob Palladus Parkinson's2 | 8.2 |
| BA7 Huntington's2 | 54.7 | Glob Palladus PSP | 1.7 |
| BA7 PSP | 43.8 | Glob Palladus PSP2 | 3.9 |
| BA7 PSP2 | 30.4 | Glob Palladus Depression | 3.8 |
| BA7 Depression | 13.6 | Temp Pole Control | 10.5 |
| BA9 Control | 19.3 | Temp Pole Control2 | 45.1 |
| BA9 Control2 | 100.0 | Temp Pole Alzheimer's | 9.6 |
| BA9 Alzheimer's | 9.5 | Temp Pole Alzheimer's2 | 2.6 |
| BA9 Alzheimer's2 | 17.1 | Temp Pole Parkinson's | 36.9 |
| BA9 Parkinson's | 27.2 | Temp Pole Parkinson's2 | 32.5 |
| BA9 Parkinson's2 | 62.0 | Temp Pole Huntington's | 37.6 |
| BA9 Huntington's | 37.9 | Temp Pole PSP | 2.9 |
| BA9 Huntington's2 | 19.3 | Temp Pole PSP2 | 13.1 |
| BA9 PSP | 11.0 | Temp Pole Depression | 11.7 |
| BA9 PSP2 | 9.3 | Cing Gyr Control | 53.2 |
| BA9 Depression | 9.4 | Cing Gyr Control2 | 40.1 |
| BA9 Depression2 | 15.0 | Cing Gyr Alzheimer's | 12.1 |
| BA17 Control | 43.8 | Cing Gyr Alzheimer's2 | 8.5 |
| BA17 Control2 | 70.7 | Cing Gyr Parkinson's | 27.5 |
| BA17 Alzheimer's2 | 15.7 | Cing Gyr Parkinson's2 | 35.4 |
| BA17 Parkinson's | 40.6 | Cing Gyr Huntington's | 37.6 |
| BA17 Parkinson's2 | 72.2 | Cing Gyr Huntington's2 | 25.5 |
| BA17 Huntington's | 42.0 | Cing Gyr PSP | 14.3 |
| BA17 Huntington's2 | 24.8 | Cing Gyr PSP2 | 4.8 |
| BA17 Depression | 9.4 | Cing Gyr Depression | 14.0 |
| BA17 Depression2 | 33.4 | Cing Gyr Depression2 | 12.1 |

CNS_neurodegeneration_v1.0 Summary: Ag1988 The CG51493-01 gene is expressed most highly in the cerebral cortex, and exhibits brain preferential expression. No specific association is notable between gene expression level and Alzheimer's disease in CNS_neurodegeneration_v1.0 panel. Please see Panel 1.3D for discussion of potential utility of this gene in the central nervous system.

Panel 1.3D Summary: Ag1988 Two experiments with the same probe and primer produce results that are in excellent agreement, with highest expression of the CG51493-01 gene in the cerebral cortex (CTs=27–29). This peak expression of the gene in the cerebral cortex, combined with a dendritic field-defining function for flamingo, suggests that the flamingo homolog encoded by this gene may control dendritic field formation in the brain. Dendritic degeneration is a prominent feature of Alzheimer's disease. Since flamingo acts as an inhibitory molecule in the expansion of dendritic fields, targeting this gene product with inhibitory small molecules or antibodies may foster neurite outgrowth by interfering with this endogenous neurite outgrowth inhibitor. Thus, this may be useful in treating the pathological neurite degeneration of Alzheimer's disease or other neurodegenerative diseases.

Among tissues with metabolic function, this gene is moderately expressed in the pituitary (CTs=30) and fetal skeletal muscle (CTs=34). Furthermore, this gene is expressed at much higher levels in fetal skeletal muscle than in adult skeletal muscle (CTs=40) and thus could potentially be used to differentiate between the two sources of the tissue.

This putative protein has a domain found in the extracellular part of some hormone receptors including the calcitonin receptor, corticotropin releasing factor receptor 1, diuretic hormone receptor, glucagon-like peptide 1 receptor, and parathyroid hormone peptide receptor. Thus, as a potential G-protein coupled receptor, this gene product may be a small molecule drug target for the treatment of diseases that involve the pituitary gland, including endocrine dysfunctions, diabetes, obesity, and growth and reproductive disorders.

Overall, there is a predominant expression pattern associated with cancer cell lines, when compared to normal adult tissues. Evidence for this are the clusters of expression of this gene in lung, renal, prostate and melanoma cell lines. This data suggest that the expression of this gene might be associated with these forms of cancer and thus, therapeutic modulation of this gene might be of use in the treatment of these cancers Panel 2D Summary: Ag1988 The expression of the CG51493-01 is highest in breast cancer (CTs=28–29) in two experiments with the same probe and primer set. colon, breast and bladder cancers express this gene at a higher level than the normal adjacent tissue. These data indicate that the expression of this gene might be associated with these forms of cancer and could be used as a diagnostic marker. Furthermore, therapeutic modulation of this gene might be of use in the treatment of these cancers.

Panel 3D Summary: Ag1988 The CG51493-01 gene is widely expressed in the cancer cell lines on this panel including colon, lung, gastric, brain, uterine, pancreatic and some sarcoma cell lines. This suggests that expression of this gene is potentially useful for cell growth and proliferation and that expression of this gene might be associated with these cancer tissues Thus, expression of this gene could potentially be used as a diagnostic marker and therapeutic modulation of this gene might be of use in the treatment of cancer.

Panel 4D Summary: Ag 1988 The expression of the CG51493-01 transcript is moderate in the pulmonary mucoepidermoid cell line NCI-H292 and is up-regulated by IL-4 and IL-9 treatment (CTs=29.5). Both cytokines have been reported to induce mucin gene expression in this cell line and therefore have been postulated to contribute to the pathogenesis of chronic obstructive pulmonary disease, emphysema and asthma. This transcript encodes for a protocadherin flamingo 1 like molecule, which belongs to the cadherin family. Members of the cadherin family play an important role in specific cell—cell adhesion events. Thus, modulation of the expression levels or functionality of this putative protein through the application of antibodies or small molecules may reduce or eliminate symptoms caused by inflammation in lung epithelia in chronic obstructive pulmonary disease, asthma, allergy, and emphysema.

This transcript is also moderately expressed in activated Ramos B cells and at a lower but still significant level in normal activated B cells. This suggests that therapeutics designed against this putative protein may reduce or prevent the accumulation of B cells in inflamed tissues and therefore be useful for the treatment of rheumatoid arthritis and lupus.

Panel CNS_1 Summary: Ag1988 This panel confirms expression of this gene in the brain. See Panel 1.3D for discussion of utility of this gene in the central nervous system.

C. CG55806-01: Human Factor IX (NOV3)

Expression of gene CG55806-01 was assessed using the primer-probe set Ag2613, described in Table CA. Results of the RTQ-PCR runs are shown in Tables CB, CC and CD.

TABLE CA

Probe Name Ag2613

| Primers | Sequences | Start Position | SEQ ID NO |
|---|---|---|---|
| Forward | 5'-agccacatgtcttcgatctaca-3' | 937 | 281 |
| Probe | TET-5'-acaacatgttctgtgctggcttccat-3'-TAMRA | 975 | 282 |
| Reverse | 5'-cccactatctccttgacatgaa-3' | 1015 | 283 |

TABLE CB

Panel 1.3D

| Tissue Name | Rel. Exp. (%) Ag2613, Run 165672326 | Tissue Name | Rel. Exp. (%) Ag2613, Run 165672326 |
|---|---|---|---|
| Liver adenocarcinoma | 0.0 | Kidney (fetal) | 10.7 |
| Pancreas | 0.0 | Renal ca. 786-0 | 0.0 |
| Pancreatic ca. CAPAN 2 | 0.0 | Renal ca. A498 | 0.0 |
| Adrenal gland | 0.0 | Renal ca. RXF 393 | 0.0 |
| Thyroid | 0.0 | Renal ca. ACHN | 0.0 |
| Salivary gland | 0.0 | Renal ca. UO-31 | 0.0 |
| Pituitary gland | 0.0 | Renal ca. TK-10 | 0.0 |
| Brain (fetal) | 0.0 | Liver | 100.0 |
| Brain (whole) | 0.0 | Liver (fetal) | 76.3 |
| Brain (amygdala) | 0.0 | Liver ca. (hepatoblast) HepG2 | 0.0 |
| Brain (cerebellum) | 0.0 | Lung | 0.0 |
| Brain (hippocampus) | 0.0 | Lung (fetal) | 0.0 |
| Brain (substantia nigra) | 0.0 | Lung ca. (small cell) LX-1 | 0.0 |
| Brain (thalamus) | 0.0 | Lung ca. (small cell) NCI-H69 | 0.0 |
| Cerebral Cortex | 0.0 | Lung ca. (s.cell var.) SHP-77 | 0.3 |
| Spinal cord | 0.0 | Lung ca. (large cell)NCI-H460 | 0.0 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |
| astrocytoma SW1783 | 0.0 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 0.0 |
| glioma U251 | 0.0 | Breast ca.* (pl.ef) MCF-7 | 0.0 |
| glioma SF-295 | 0.0 | Breast ca.* (pl.ef) MDA-MB-231 | 0.2 |
| Heart (fetal) | 0.0 | Breast ca.* (pl.ef) T47D | 0.0 |
| Heart | 0.0 | Breast ca. BT-549 | 0.0 |
| Skeletal muscle (fetal) | 0.0 | Breast ca. MDA-N | 0.0 |
| Skeletal muscle | 0.0 | Ovary | 0.0 |
| Bone marrow | 0.0 | Ovarian ca. OVCAR-3 | 0.0 |
| Thymus | 0.0 | Ovarian ca. OVCAR-4 | 0.0 |
| Spleen | 0.0 | Ovarian ca. OVCAR-5 | 0.0 |
| Lymph node | 0.0 | Ovarian ca. OVCAR-8 | 0.0 |
| Colorectal | 0.0 | Ovarian ca. IGROV-1 | 0.0 |
| Stomach | 0.0 | Ovarian ca.* (ascites) SK-OV-3 | 0.0 |
| Small intestine | 0.0 | Uterus | 0.0 |
| Colon ca. SW480 | 0.0 | Placenta | 0.0 |
| Colon ca.* SW620(SW480 met) | 0.0 | Prostate | 0.0 |
| Colon ca. HT29 | 0.0 | Prostate ca.* (bone met)PC-3 | 0.0 |
| Colon ca. HCT-116 | 0.0 | Testis | 0.0 |
| Colon ca. CaCo-2 | 0.0 | Melanoma Hs688(A).T | 0.0 |
| Colon ca. tissue(ODO3866) | 0.0 | Melanoma* (met) Hs688(B).T | 0.0 |
| Colon ca. HCC-2998 | 0.0 | Melanoma UACC-62 | 0.0 |
| Gastric ca.* (liver met) NCI-N87 | 0.0 | Melanoma M14 | 0.0 |
| Bladder | 0.0 | Melanoma LOX IMVI | 0.0 |
| Trachea | 0.0 | Melanoma* (met) SK-MEL-5 | 0.0 |
| Kidney | 0.0 | Adipose | 0.0 |

TABLE CC

Panel 2.2

| Tissue Name | Rel. Exp. (%) Ag2613, Run 175128272 | Tissue Name | Rel. Exp. (%) Ag2613, Run 175128272 |
|---|---|---|---|
| Normal Colon | 0.4 | Kidney Margin (OD04348) | 0.0 |
| Colon cancer (OD06064) | 0.0 | Kidney malignant cancer (OD06204B) | 0.0 |
| Colon Margin (OD06064) | 0.0 | Kidney normal adjacent tissue (OD06204E) | 0.0 |
| Colon cancer (OD06159) | 0.0 | Kidney Cancer (OD04450-01) | 0.0 |
| Colon Margin (OD06159) | 0.0 | Kidney Margin (OD04450-03) | 0.0 |
| Colon cancer (OD06297-04) | 0.0 | Kidney Cancer 8120613 | 0.0 |
| Colon Margin (OD06297-015) | 0.0 | Kidney Margin 8120614 | 0.0 |
| CC Gr.2 ascend colon (ODO3921) | 0.0 | Kidney Cancer 9010320 | 0.0 |
| CC Margin (ODO3921) | 0.0 | Kidney Margin 9010321 | 0.0 |
| Colon cancer metastasis (OD06104) | 0.0 | Kidney Cancer 8120607 | 0.0 |
| Lung Margin (OD06104) | 0.0 | Kidney Margin 8120608 | 0.0 |
| Colon mets to lung (OD04451-01) | 0.1 | Normal Uterus | 0.1 |
| Lung Margin (OD04451-02) | 0.0 | Uterine Cancer 064011 | 0.0 |
| Normal Prostate | 0.0 | Normal Thyroid | 0.0 |
| Prostate Cancer (OD04410) | 0.0 | Thyroid Cancer 064010 | 0.0 |
| Prostate Margin (OD04410) | 0.0 | Thyroid Cancer A302152 | 0.0 |
| Normal Ovary | 0.0 | Thyroid Margin A302153 | 0.0 |
| Ovarian cancer (OD06283-03) | 0.0 | Normal Breast | 0.0 |
| Ovarian Margin (OD06283-07) | 0.0 | Breast Cancer (OD04566) | 1.5 |
| Ovarian Cancer 064008 | 2.1 | Breast Cancer 1024 | 0.0 |
| Ovarian cancer (OD06145) | 1.0 | Breast Cancer (OD04590-01) | 0.2 |
| Ovarian Margin (OD06145) | 0.2 | Breast Cancer Mets (OD04590-03) | 0.0 |
| Ovarian cancer (OD06455-03) | 0.0 | Breast Cancer Metastasis (OD04655-05) | 0.0 |
| Ovarian Margin (OD06455-07) | 0.0 | Breast Cancer 064006 | 0.1 |
| Normal Lung | 0.2 | Breast Cancer 9100266 | 0.0 |
| Invasive poor diff. lung adeno (ODO4945-01) | 0.0 | Breast Margin 9100265 | 0.0 |
| Lung Margin (ODO4945-03) | 0.0 | Breast Cancer A209073 | 0.0 |
| Lung Malignant Cancer (OD03126) | 0.0 | Breast Margin A2090734 | 0.0 |
| Lung Margin (OD03126) | 0.0 | Breast cancer (OD06083) | 0.0 |
| Lung Cancer (OD05014A) | 0.0 | Breast cancer node metastasis (OD06083) | 0.0 |
| Lung Margin (OD05014B) | 0.4 | Normal Liver | 100.0 |
| Lung cancer (OD06081) | 0.0 | Liver Cancer 1026 | 1.9 |
| Lung Margin (OD06081) | 0.0 | Liver Cancer 1025 | 60.3 |
| Lung Cancer (OD04237-01) | 0.0 | Liver Cancer 6004-T | 42.6 |
| Lung Margin (OD04237-02) | 0.0 | Liver Tissue 6004-N | 1.4 |
| Ocular Melanoma Metastasis | 0.0 | Liver Cancer 6005-T | 3.3 |
| Ocular Melanoma Margin (Liver) | 51.4 | Liver Tissue 6005-N | 33.7 |
| Melanoma Metastasis | 0.0 | Liver Cancer 064003 | 59.0 |
| Melanoma Margin (Lung) | 0.0 | Normal Bladder | 0.0 |
| Normal Kidney | 0.0 | Bladder Cancer 1023 | 0.0 |
| Kidney Ca, Nuclear grade 2 (OD04338) | 0.0 | Bladder Cancer A302173 | 0.0 |
| Kidney Margin (OD04338) | 0.0 | Normal Stomach | 0.1 |
| Kidney Ca Nuclear grade 1/2 (OD04339) | 0.0 | Gastric Cancer 9060397 | 0.0 |
| Kidney Margin (OD04339) | 0.0 | Stomach Margin 9060396 | 0.0 |
| Kidney Ca, Clear cell type (OD04340) | 0.0 | Gastric Cancer 9060395 | 0.2 |
| Kidney Margin (OD04340) | 0.0 | Stomach Margin 9060394 | 0.0 |
| Kidney Ca, Nuclear grade 3 (OD04348) | 0.0 | Gastric Cancer 064005 | 0.0 |

TABLE CD

Panel 4D

| Tissue Name | Rel. Exp. (%) Ag2613, Run 164399517 | Tissue Name | Rel. Exp. (%) Ag2613, Run 164399517 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 0.0 | Microvascular Dermal EC none | 0.0 |
| Primary Tr1 act | 0.0 | Microvsavular Dermal EC TNFalpha + IL-1beta | 0.0 |
| Primary Th1 rest | 0.0 | Bronchial epithelium TNFalpha + IL1beta | 0.0 |
| Primary Th2 rest | 0.0 | Small airway epithelium none | 0.0 |
| Primary Tr1 rest | 0.0 | Small airway epithelium TNFalpha + IL-1beta | 0.0 |

TABLE CD-continued

Panel 4D

| Tissue Name | Rel. Exp. (%) Ag2613, Run 164399517 | Tissue Name | Rel. Exp. (%) Ag2613, Run 164399517 |
|---|---|---|---|
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 0.0 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1beta | 0.0 |
| LAK cells IL-2 | 0.0 | Liver cirrhosis | 100.0 |
| LAK cells IL-2 + IL-12 | 0.0 | Lupus kidney | 0.0 |
| LAK cells IL-2 + IFN gamma | 0.0 | NCI-H292 none | 0.0 |
| LAK cells IL-2 + IL-18 | 0.0 | NCI-H292 IL-4 | 0.0 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 0.0 | Lung fibroblast none | 0.0 |
| PBMC PWM | 0.0 | Lung fibroblast TNF alpha + IL-1beta | 0.0 |
| PBMC PHA-L | 0.0 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1beta | 0.0 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti- | 0.0 | IBD Colitis 2 | 0.0 |
| CD40 Monocytes rest | 0.0 | IBD Crohn's | 0.0 |
| Monocytes LPS | 0.0 | Colon | 0.0 |
| Macrophages rest | 0.0 | Lung | 1.0 |
| Macrophages LPS | 0.0 | Thymus | 0.0 |
| HUVEC none | 0.0 | Kidney | 0.0 |
| HUVEC starved | 0.0 | | |

Panel 1.3D Summary: Ag2613 Expression of the CG55806-01 gene is limited to the liver and fetal kidney samples on this panel (CTs=27–31). This gene encodes a protein that is homologous to factor IX. The secreted form of the protein may be present in the circulatory system and exhibit effects that are unrelated to the site of synthesis. Based on the expression profile of this gene, expression of this gene could be used to differentiate between liver derived tissue and other tissues. Furthermore, therapeutic modulation of the expression or function of this gene product may be effective in correcting the alterations to coagulation system seen in hemophilia and other liver related disease.

Panel 2.2 Summary: Ag2613 Expression of the CG55806-01 gene is highest in samples derived from liver (CT=27.9), a result that is consistent with the results seen in Panel 1.3D. Therefore, expression of this gene could be used to differentiate between normal sections of liver as compared to tumors that are secondary metastases from other sites (such as melanoma).

Panel 4D Summary: Ag2613 The CG55806-01 transcript is highly expressed in cirrhotic liver tissue (CT=27.8). This liver specific expression is also seen in the previous panels, suggesting that this transcript or the protein it encodes could be used as a diagnostic marker for liver tissue.

D. CG55936-01: Carbonic Anhydrase IV Precursor (NOV4)

Expression of gene CG55936-01 was assessed using the primer-probe set Ag1677, described in Table DA. Results of the RTQ-PCR runs are shown in Tables DB, DC, DD, DE and DF.

TABLE DA

Probe Name Ag1677

| Primers | Sequences | Start Position | SEQ ID NO |
|---|---|---|---|
| Forward | 5'-cccattcagcttcacagaga-3' | 260 | 284 |
| Probe | TET-5'-cagatcctggcattctctcagaagctg-3'-TAMRA | 232 | 285 |
| Reverse | 5'-atgctcactgtctgttccttgt-3' | 203 | 286 |

TABLE DB

CNS_neurodegeneration_v1.0

| Tissue Name | Rel. Exp. (%) Ag1677, Run 209733901 | Tissue Name | Rel. Exp. (%) Ag1677, Run 209733901 |
|---|---|---|---|
| AD 1 Hippo | 9.9 | Control (Path) 3 Temporal Ctx | 8.2 |
| AD 2 Hippo | 16.7 | Control (Path) 4 Temporal Ctx | 75.8 |
| AD 3 Hippo | 5.3 | AD 1 Occipital Ctx | 14.4 |
| AD 4 Hippo | 26.2 | AD 2 Occipital Ctx (Missing) | 2.5 |
| AD 5 Hippo | 40.6 | AD 3 Occipital Ctx | 5.9 |
| AD 6 Hippo | 15.6 | AD 4 Occipital Ctx | 48.6 |
| Control 2 Hippo | 19.9 | AD 5 Occipital Ctx | 20.3 |
| Control 4 Hippo | 21.8 | AD 6 Occipital Ctx | 19.3 |
| Control (Path) 3 Hippo | 8.5 | Control 1 Occipital Ctx | 11.4 |
| AD 1 Temporal Ctx | 8.7 | Control 2 Occipital Ctx | 25.7 |
| AD 2 Temporal Ctx | 75.3 | Control 3 Occipital Ctx | 18.0 |
| AD 3 Temporal Ctx | 5.1 | Control 4 Occipital Ctx | 9.3 |
| AD 4 Temporal Ctx | 92.0 | Control (Path) 1 Occipital Ctx | 46.0 |
| AD 5 Inf Temporal Ctx | 100.0 | Control (Path) 2 Occipital Ctx | 48.0 |
| AD 5 Sup Temporal Ctx | 37.9 | Control (Path) 3 Occipital Ctx | 4.2 |
| AD 6 Inf Temporal Ctx | 19.5 | Control (Path) 4 Occipital Ctx | 7.8 |
| AD 6 Sup Temporal Ctx | 15.7 | Control 1 Parietal Ctx | 26.6 |
| Control 1 Temporal Ctx | 11.7 | Control 2 Parietal Ctx | 16.0 |
| Control 2 Temporal Ctx | 21.6 | Control 3 Parietal Ctx | 30.4 |
| Control 3 Temporal Ctx | 17.1 | Control (Path) 1 Parietal Ctx | 24.0 |
| Control 3 Temporal Ctx | 25.3 | Control (Path) 2 Parietal Ctx | 47.3 |
| Control (Path) 1 Temporal Ctx | 70.7 | Control (Path) 3 Parietal Ctx | 4.5 |
| Control (Path) 2 Temporal Ctx | 56.3 | Control (Path) 4 Parietal Ctx | 15.7 |

TABLE DC

General_screening_panel_v1.4

| Tissue Name | Rel. Exp. (%) Ag1677, Run 208021859 | Tissue Name | Rel. Exp. (%) Ag1677, Run 208021859 |
|---|---|---|---|
| Adipose | 21.3 | Renal ca. TK-10 | 0.6 |
| Melanoma* Hs688(A).T | 0.3 | Bladder | 6.3 |
| Melanoma* HS688(B).T | 0.1 | Gastric ca. (liver met.) NCI-N87 | 0.2 |
| Melanoma* M14 | 0.1 | Gastric ca. KATO III | 0.1 |
| Melanoma* LOXIMVI | 0.2 | Colon ca. SW-948 | 0.3 |
| Melanoma* SK-MEL-5 | 0.7 | Colon ca. SW480 | 0.2 |
| Squamous cell carcinoma SCC-4 | 0.2 | Colon ca.* (SW480 met) SW620 | 0.4 |
| Testis Pool | 4.7 | Colon ca. HT29 | 1.3 |
| Prostate ca.* (bone met) PC-3 | 0.3 | Colon ca. HCT-116 | 0.4 |
| Prostate Pool | 3.0 | Colon ca. CaCo-2 | 3.5 |
| Placenta | 6.3 | Colon cancer tissue | 1.9 |
| Uterus Pool | 2.0 | Colon ca. SW1116 | 0.6 |
| Ovarian ca. OVCAR-3 | 0.2 | Colon ca. Colo-205 | 0.4 |
| Ovarian ca. SK-OV-3 | 0.2 | Colon ca. SW-48 | 0.4 |
| Ovarian ca. OVCAR-4 | 0.3 | Colon Pool | 6.2 |
| Ovarian ca. OVCAR-5 | 0.3 | Small Intestine Pool | 3.8 |
| Ovarian ca. IGROV-1 | 0.6 | Stomach Pool | 3.8 |
| Ovarian ca. OVCAR-8 | 0.8 | Bone Marrow Pool | 1.8 |
| Ovary | 1.8 | Fetal Heart | 19.1 |
| Breast ca. MCF-7 | 24.0 | Heart Pool | 21.0 |
| Breast ca. MDA-MB-231 | 0.4 | Lymph Node Pool | 4.7 |
| Breast ca. BT 549 | 23.8 | Fetal Skeletal Muscle | 4.4 |
| Breast ca. T47D | 0.7 | Skeletal Muscle Pool | 14.0 |
| Breast ca. MDA-N | 0.7 | Spleen Pool | 2.5 |
| Breast Pool | 3.6 | Thymus Pool | 3.3 |
| Trachea | 2.7 | CNS cancer (glio/astro) U87-MG | 0.1 |
| Lung | 2.9 | CNS cancer (glio/astro) U-118-MG | 1.0 |
| Fetal Lung | 82.4 | CNS cancer (neuro;met) SK-N-AS | 0.1 |
| Lung ca. NCI-N417 | 0.1 | CNS cancer (astro) SF-539 | 0.2 |
| Lung ca. LX-1 | 0.2 | CNS cancer (astro) SNB-75 | 0.7 |
| Lung ca. NCI-H146 | 0.2 | CNS cancer (glio) SNB-19 | 1.3 |
| Lung ca. SHP-77 | 31.6 | CNS cancer (gilo) SF-295 | 0.2 |
| Lung ca. A549 | 0.9 | Brain (Amygdala) Pool | 12.1 |
| Lung ca. NCI-H526 | 0.5 | Brain (cerebellum) | 100.0 |
| Lung ca. NCI-H23 | 0.3 | Brain (fetal) | 3.0 |
| Lung ca. NCI-H460 | 0.2 | Brain (Hippocampus) Pool | 8.4 |
| Lung ca. HOP-62 | 0.2 | Cerebral Cortex Pool | 21.2 |
| Lung ca. NCI-H522 | 0.0 | Brain (Substantia nigra) Pool | 22.7 |
| Liver | 0.4 | Brain (Thalamus) Pool | 14.5 |
| Fetal Liver | 0.7 | Brain (whole) | 22.1 |
| Liver ca. HepG2 | 0.3 | Spinal Cord Pool | 5.3 |
| Kidney Pool | 14.8 | Adrenal Gland | 2.9 |
| Fetal Kidney | 19.6 | Pituitary gland Pool | 10.4 |
| Renal ca. 786-0 | 0.4 | Salivary Gland | 5.1 |
| Renal ca. A498 | 0.5 | Thyroid (female) | 39.5 |
| Renal ca. ACHN | 0.2 | Pancreatic ca. CAPAN2 | 0.4 |
| Renal ca. UO-31 | 0.2 | Pancreas Pool | 6.1 |

TABLE DD

Panel 1.3D

| Tissue Name | Rel. Exp. (%) Ag1677, Run 152171910 | Rel. Exp. (%) Ag1677, Run 165532764 | Tissue Name | Rel. Exp. (%) Ag1677, Run 152171910 | Rel. Exp. (%) Ag1677, Run 165532764 |
|---|---|---|---|---|---|
| Liver adenocarcinoma | 0.0 | 0.1 | Kidney (fetal) | 1.9 | 7.0 |
| Pancreas | 14.8 | 23.5 | Renal ca. 786-0 | 0.0 | 0.0 |
| Pancreatic ca. CAPAN 2 | 0.0 | 0.1 | Renal ca. A498 | 0.0 | 0.2 |
| Adrenal gland | 2.1 | 3.3 | Renal ca. RXF 393 | 0.0 | 1.0 |
| Thyroid | 36.1 | 37.1 | Renal ca. ACHN | 0.0 | 0.5 |
| Salivary gland | 3.2 | 10.0 | Renal ca. UO-31 | 0.0 | 0.0 |
| Pituitary gland | 6.4 | 10.4 | Renal ca. TK-10 | 0.0 | 0.3 |
| Brain (fetal) | 0.8 | 1.6 | Liver | 0.0 | 0.9 |
| Brain (whole) | 13.2 | 36.6 | Liver (fetal) | 0.0 | 1.9 |
| Brain (amygdala) | 4.6 | 17.9 | Liver ca. (hepatoblast) HepG2 | 0.0 | 0.0 |
| Brain (cerebellum) | 11.1 | 74.2 | Lung | 100.0 | 100.0 |
| Brain (hippocampus) | 23.8 | 30.6 | Lung (fetal) | 59.5 | 72.2 |
| Brain (substantia nigra) | 4.6 | 18.7 | Lung ca. (small cell) LX-1 | 0.0 | 1.1 |
| Brain (thalamus) | 3.5 | 20.2 | Lung ca. (small cell) NCI-H69 | 0.0 | 0.2 |
| Cerebral Cortex | 22.4 | 28.3 | Lung ca. (s. cell var.) SHP-77 | 0.0 | 0.7 |
| Spinal cord | 0.9 | 6.9 | Lung ca. (large cell)NCI-H460 | 0.0 | 0.7 |
| glio/astro U87-MG | 0.0 | 0.1 | Lung ca. (non-sm. cell) A549 | 0.0 | 0.9 |
| glio/astro U-118-MG | 0.0 | 2.2 | Lung ca. (non-s. cell) NCI-H23 | 0.2 | 1.0 |
| astrocytoma SW1783 | 0.0 | 0.7 | Lung ca. (non-s. cell) HOP-62 | 0.0 | 0.3 |
| neuro*; met SK-N-AS | 0.0 | 0.5 | Lung ca. (non-s. cl) NCI-H522 | 0.0 | 0.8 |
| astrocytoma SF-539 | 0.1 | 0.7 | Lung ca. (squam.) SW 900 | 0.0 | 0.7 |
| astrocytoma SNB-75 | 0.0 | 1.0 | Lung ca. (squam.) NCI-H596 | 0.0 | 0.6 |
| glioma SNB-19 | 0.0 | 1.0 | Mammary gland | 16.7 | 19.5 |
| glioma U251 | 0.0 | 1.1 | Breast ca.* (pl. ef) MCF-7 | 3.8 | 5.3 |
| glioma SF-295 | 0.0 | 1.2 | Breast ca.* (pl. ef) MDA-MB-231 | 0.0 | 0.2 |
| Heart (fetal) | 55.5 | 40.6 | Breast ca.* (pl. ef) T47D | 0.0 | 0.7 |
| Heart | 11.9 | 47.0 | Breast ca. BT-549 | 0.4 | 2.2 |
| Skeletal muscle (fetal) | 41.2 | 22.7 | Breast ca. MDA-N | 0.0 | 0.9 |
| Skeletal muscle | 2.0 | 22.4 | Ovary | 3.5 | 3.1 |
| Bone marrow | 4.8 | 12.1 | Ovarian ca. OVCAR-3 | 0.0 | 1.3 |
| Thymus | 0.4 | 1.9 | Ovarian ca. OVCAR-4 | 0.0 | 0.0 |
| Spleen | 2.3 | 3.2 | Ovarian ca. OVCAR-5 | 0.0 | 0.6 |
| Lymph node | 4.2 | 15.7 | Ovarian ca. OVCAR-8 | 0.0 | 1.4 |
| Colorectal | 57.4 | 64.2 | Ovarian ca. IGROV-1 | 0.0 | 0.3 |
| Stomach | 11.6 | 20.9 | Ovarian ca.* | 0.0 | 0.7 |

TABLE DD-continued

Panel 1.3D

| Tissue Name | Rel. Exp. (%) Ag1677, Run 152171910 | Rel. Exp. (%) Ag1677, Run 165532764 | Tissue Name | Rel. Exp. (%) Ag1677, Run 152171910 | Rel. Exp. (%) Ag1677, Run 165532764 |
|---|---|---|---|---|---|
| Small intestine | 4.0 | 7.5 | (ascites) SK-OV-3 Uterus | 2.5 | 19.6 |
| Colon ca. SW480 | 0.0 | 0.1 | Placenta | 3.7 | 4.3 |
| Colon ca.* SW620(SW480 met) | 0.0 | 0.2 | Prostate | 4.5 | 8.4 |
| Colon ca. HT29 | 0.0 | 0.2 | Prostate ca.* (bone met)PC-3 | 0.0 | 0.2 |
| Colon ca. HCT-116 | 0.0 | 0.9 | Testis | 0.5 | 3.2 |
| Colon ca. CaCo-2 | 0.4 | 1.5 | Melanoma Hs688(A).T | 0.0 | 0.7 |
| Colon ca. tissue(ODO3866) | 0.9 | 3.0 | Melanoma* (met) Hs688(B).T | 0.0 | 0.0 |
| Colon ca. HCC-2998 | 0.5 | 2.4 | Melanoma UACC-62 | 0.0 | 0.4 |
| Gastric ca.* (liver met) NCI-N87 | 0.0 | 0.6 | Melanoma M14 | 0.0 | 0.2 |
| Bladder | 0.0 | 2.7 | Melanoma LOX IMVI | 0.0 | 0.6 |
| Trachea | 2.4 | 6.6 | Melanoma* (met) SK-MEL-5 | 0.0 | 0.6 |
| Kidney | 9.6 | 37.9 | Adipose | 7.2 | 15.3 |

TABLE DE

Panel 2D

| Tissue Name | Rel. Exp. (%) Ag1677, Run 152570595 | Tissue Name | Rel. Exp. (%) Ag1677, Run 152570595 | Tissue Name | Rel. Exp. (%) Ag1677, Run 152570595 | Tissue Name | Rel. Exp. (%) Ag1677, Run 152570595 |
|---|---|---|---|---|---|---|---|
| Normal Colon | 63.3 | Kidney Margin 8120608 | 26.6 | Prostate Cancer (OD04720-01) | 0.5 | (OD04655-05) Breast Cancer 064006 | 0.1 |
| CC Well to Mod Diff (ODO3866) | 0.5 | Kidney Cancer 8120613 | 2.3 | Prostate Margin (OD04720-02) | 1.3 | Breast Cancer 1024 | 5.6 |
| CC Margin (ODO3866) | 77.9 | Kidney Margin 8120614 | 50.0 | Normal Lung 061010 | 36.3 | Breast Cancer 9100266 | 0.3 |
| CC Gr.2 rectosigmoid (ODO3868) | 5.3 | Kidney Cancer 9010320 | 0.7 | Lung Met to Muscle (ODO4286) | 0.1 | Breast Margin 9100265 | 0.7 |
| CC Margin (ODO3868) | 2.2 | Kidney Margin 9010321 | 26.2 | Muscle Margin (ODO4286) | 2.7 | Breast Cancer A209073 | 0.3 |
| CC Mod Diff (ODO3920) | 29.5 | Normal Uterus | 0.6 | Lung Malignant Cancer (OD03126) | 6.1 | Breast Margin A2090734 | 1.3 |
| CC Margin (ODO3920) | 100.0 | Uterus Cancer 064011 | 1.9 | Lung Margin (OD03126) | 63.7 | Normal Liver | 0.0 |
| CC Gr.2 ascend colon (ODO3921) | 30.6 | Normal Thyroid | 21.9 | Lung Cancer (OD04404) | 3.5 | Liver Cancer 064003 | 0.1 |
| CC Margin (ODO3921) | 42.9 | Thyroid Cancer 064010 | 0.6 | Lung Margin (OD04404) | 17.3 | Liver Cancer 1025 | 0.0 |
| CC from Partial Hepatectomy (ODO4309) Mets | 1.0 | Thyroid Cancer A302152 | 1.1 | Lung Cancer (OD04565) | 0.0 | Liver Cancer 1026 | 0.0 |
| Liver Margin (ODO4309) | 0.0 | Thyroid Margin A302153 | 14.5 | Lung Margin (OD04565) | 21.3 | Liver Cancer 6004-T | 0.2 |
| Colon mets to lung (OD04451-01) | 1.5 | Normal Breast | 6.6 | Lung Cancer (OD04237-01) | 0.2 | Liver Tissue 6004-N | 0.0 |
| Lung Margin (OD04451-02) | 15.5 | Breast Cancer (OD04566) | 0.1 | Lung Margin (OD04237-02) | 17.9 | Liver Cancer 6005-T | 0.2 |
| Normal Prostate 6546-1 | 3.3 | Breast Cancer (OD04590-01) | 0.6 | Ocular Mel Met to Liver (ODO4310) | 0.1 | Liver Tissue 6005-N | 0.0 |
| Prostate Cancer (OD04410) | 1.8 | Breast Cancer Mets (OD04590-03) | 5.1 | Liver Margin (ODO4310) | 0.0 | Normal Bladder | 1.3 |
| Prostate Margin (OD04410) | 1.4 | Breast Cancer Metastasis | 0.7 | Melanoma Mets to Lung (OD04321) | 0.1 | Bladder Cancer 1023 | 0.0 |

TABLE DE-continued

Panel 2D

| Tissue Name | Rel. Exp. (%) Ag1677, Run 152570595 | Tissue Name | Rel. Exp. (%) Ag1677, Run 152570595 |
|---|---|---|---|
| Lung Margin (OD04321) | 33.9 | Bladder Cancer A302173 | 0.0 |
| Normal Kidney | 18.4 | Bladder Cancer (OD04718-01) | 0.2 |
| Kidney Ca, Nuclear grade 2 (OD04338) | 0.8 | Bladder Normal Adjacent (OD04718-03) | 0.6 |
| Kidney Margin (OD04338) | 19.3 | Normal Ovary | 2.3 |
| Kidney Ca Nuclear grade 1/2 (OD04339) | 0.1 | Ovarian Cancer 064008 | 0.0 |
| Kidney Margin (OD04339) | 50.7 | Ovarian Cancer (OD04768-07) | 0.6 |
| Kidney Ca, Clear cell type (OD04340) | 14.9 | Ovary Margin (OD04768-08) | 0.1 |
| Kidney Margin (OD04340) | 34.4 | Normal Stomach | 1.9 |
| Kidney Ca, Nuclear grade 3 (OD04348) | 0.3 | Gastric Cancer 9060358 | 0.2 |
| Kidney Margin (OD04348) | 13.9 | Stomach Margin 9060359 | 0.8 |
| Kidney Cancer (OD04622-01) | 0.2 | Gastric Cancer 9060395 | 0.1 |
| Kidney Margin (OD04622-03) | 4.8 | Stomach Margin 9060394 | 1.2 |
| Kidney Cancer (OD04450-01) | 0.0 | Gastric Cancer 9060397 | 3.9 |
| Kidney Margin (OD04450-03) | 15.0 | Stomach Margin 9060396 | 0.5 |
| Kidney Cancer 8120607 | 0.1 | Gastric Cancer 064005 | 0.1 |

TABLE DF

Panel 4D

| Tissue Name | Rel. Exp. (%) Ag1677, Run 152571252 | Tissue Name | Rel. Exp. (%) Ag1677, Run 152571252 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 1.0 |
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 0.0 | Microvascular Dermal EC none | 0.5 |
| Primary Tr1 act | 0.0 | Microsvascular Dermal EC TNF-alpha + IL-1beta | 0.0 |
| Primary Th1 rest | 0.0 | Bronchial epithelium TNF-alpha + IL1beta | 0.0 |
| Primary Th2 rest | 0.0 | Small airway epithelium none | 0.0 |
| Primary Tr1 rest | 0.0 | Small airway epithelium TNF-alpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNF-alpha + IL-1beta | 0.8 |
| Secondary CD8 lymphocyte act | 0.0 | KU-812 (Basophil) rest | 1.4 |
| CD4 lymphocyte none | 0.0 | KU-812 (Basophil) PMA/ionomycin | 0.0 |
| 2ry Th1/Th2/Tr1_anti-CD95 CH11 | none | CCD1106 (Keratinocytes) none | 0.0 |
| LAK cells rest | 0.0 | CCD1106 (Keratinocytes) TNFalpha + IL-1beta | 0.0 |
| LAK cells IL-2 | 0.0 | Liver cirrhosis | 0.0 |
| LAK cells IL-2 + IL-12 | 0.0 | Lupus kidney | 10.5 |
| LAK cells IL-2 + IFN gamma | 0.4 | NCI-H292 none | 0.0 |
| LAK cells IL-2 + IL-18 | 0.0 | NCI-H292 IL-4 | 0.0 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 0.0 | Lung fibroblast none | 0.0 |
| PBMC PWM | 0.0 | Lung fibroblast TNF alpha + IL-1beta | 0.0 |
| PBMC PHA-L | 0.0 | Lung fibroblast IL-4 | 0.0 |
| Ramos (B cell) none | 0.8 | Lung fibroblast IL-9 | 0.0 |
| Ramos (B cell) ionomycin | 0.4 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1beta | 0.0 |
| Dendritic cells none | 0.0 | Dermal fibroblast IFN gamma | 0.0 |
| Dendritic cells LPS | 0.0 | Dermal fibroblast IL-4 | 5.8 |
| Dendritic cells anti-CD40 | 0.0 | IBD Colitis 2 | 0.5 |
| Monocytes rest | 0.0 | IBD Crohn's | 0.0 |
| Monocytes LPS | 0.0 | Colon | 9.7 |
| Macrophages rest | 0.0 | Lung | 14.1 |
| Macrophages LPS | 0.0 | Thymus | 100.0 |
| HUVEC none | 0.0 | Kidney | 3.9 |
| HUVEC starved | 0.0 | | |

CNS_neurodegeneration_v1.0 Summary: Ag1677 No change of expression of the CG55936-01 gene is noted in Alzheimer's disease, consistent with the scientific literature. However, this panel does confirm expression of this gene in the brain. Please see Panel 1.3D for discussion of utility of this gene in the central nervous system.

General_screening panel_v1.4 Summary: Ag1677 Highest expression of the CG55936-01 gene in this panel is seen in the cerebellum (CT=26.2), with expression also seen across all brain areas represented in this panel. This expression profile is consistent with the brain expression seen in the CNS_neurodegeneration_v1.0 panel. Please see Panel 1.3D for discussion of utility of this gene in the central nervous system.

Overall, this gene is expressed in normal tissues, with much lower expression in most cancer cell lines. This suggests that loss of expression of this gene might be required for the proliferation of these cancer cell lines. A moderate level of expression is seen in a lung cancer and two breast cancer cell lines. Thus, the loss of expression might be used as a diagnostic marker for most cancers, except the cancer tissues from which the lung and breast cancer cell lines were derived. In addition, the protein product of this gene might be of use in the treatment of these cancers.

This gene is also moderately expressed in a wide variety of metabolic tissues including pancreas, adrenal, thyroid, pituitary, adult and fetal heart, adult and fetal skeletal muscle, adult and fetal liver, and adipose. Carbonic anhydrase III is reduced in adipose tissue in several animal models of genetic obesity. Thus, an activator of this gene product could potentially be a drug treatment for the prevention and/or treatment of obesity in humans.

In addition, this gene is expressed at higher levels in fetal lung (CT=26.5) than in adult lung (CT=31.3). Thus, expression of this gene could be used to differentiate between fetal and adult lung tissue. The expression of this gene at significant levels in the lung is consistent with published reports (see references below.) This suggests that the gene product is involved in the homeostasis of the lung. Therefore, therapeutic modulation of the expression or function of the protein encoded by this gene could be effective in treating disease that affect the lung or its function.

thyroid, pituitary, adult and fetal heart, adult and fetal skeletal muscle, and adipose. Thus, this gene product may be a small molecule target for the treatment of metabolic disease, including Types 1 and 2 diabetes.

This gene encodes a homolog of carbonic anhydrase, which is a known marker for oligodendroglia. Carbonic anhydrase expression in the brain is useful for distinguishing between neurons and oligodendroglia. Thus, this gene product may utility in monitoring the progression of diseases that involve the myelinating function of oligodendroglia, such as Multiple Sclerosis and Alzheimer's disease.

Panel 2D Summary: Ag1677 As in the previous panels, expression of the CG55936-01 gene is more highly associated with normal tissues. Highest expression of the gene in this panel is seen in a normal colon sample (CT=27.8). Furthermore, expression of this gene is higher in normal colon, stomach, ovary, thyroid, kidney and lung than in the corresponding adjacent tumor tissues. Thus, the loss of expression of this gene could be used to distinguish malignant colon, lung, stomach, ovary, thyroid, and kidney tissue from normal tissue from these organs. In addition, the protein product of this gene might be of use in the treatment of these cancers.

Panel 4D Summary: Ag1677 The CG55936-01 transcript is expressed at low but significant levels in the thymus, lung and kidney (CTs=30–35), again showing preferential expression in normal tissues. Thus, this gene or the protein it encodes could be used to detect these tissues. Therapeutically, the protein encoded for by this transcript could be used for immune modulation by regulating T cell development in the thymus.

E. CG55784-01: Neural Cell Adhesion Molecule Related Protein (NOV5)

Expression of gene CG55784-01 was assessed using the primer-probe set Ag2844, described in Table EA. Results of the RTQ-PCR runs are shown in Tables EB, EC, ED, and EE.

TABLE EA

Probe Name Ag2844

| Primers | Sequences | Start Position | SEQ ID NO |
|---|---|---|---|
| Forward | 5'-ctttccactgctctgcaaag-3' | 113 | 287 |
| Probe | TET-5'-aacccagctgtcacccagtacaggtg-3'-TAMRA | 136 | 288 |
| Reverse | 5'-gtcctgtacacctctccagatg-3' | 191 | 289 |

Panel 1.3D Summary: Ag1677 The expression of the CG55936-01 gene was assessed in two independent runs on this panel and there appears to be good concordance between runs. Overall, this gene is expressed in normal tissues, with much lower expression in most cancer cell lines. Highest expression of the gene in this panel is seen in the lung (CTs=28). This significant expression in the lung is consistent with the results in General_screening_panel_1.4 and suggests that this gene product is involved in the homeostasis of this organ. The higher association of this gene with normal tissues suggests that loss of expression of this gene might be required for the proliferation of the cancer cell lines in this panel. Thus, this loss of expression might be used as a diagnostic marker for cancer.

As in the previous panel, this gene is widely expressed in a variety of metabolic tissues including pancreas, adrenal,

TABLE EB

CNS_neurodegeneration_v1.0

| Tissue Name | Rel. Exp. (%) Ag2844, Run 208699693 | Tissue Name | Rel. Exp. (%) Ag2844, Run 208699693 |
|---|---|---|---|
| AD 1 Hippo | 15.1 | Control (Path) 3 Temporal Ctx | 2.6 |
| AD 2 Hippo | 29.1 | Control (Path) 4 Temporal Ctx | 21.5 |
| AD 3 Hippo | 3.6 | AD 1 Occipital Ctx | 8.8 |
| AD 4 Hippo | 7.3 | AD 2 Occipital Ctx (Missing) | 0.0 |
| AD 5 hippo | 45.7 | AD 3 Occipital Ctx | 3.3 |

TABLE EB-continued

CNS_neurodegeneration_v1.0

| Tissue Name | Rel. Exp. (%) Ag2844, Run 208699693 | Tissue Name | Rel. Exp. (%) Ag2844, Run 208699693 |
|---|---|---|---|
| AD 6 Hippo | 22.5 | AD 4 Occipital Ctx | 24.0 |
| Control 2 Hippo | 32.5 | AD 5 Occipital Ctx | 12.2 |
| Control 4 Hippo | 7.7 | AD 6 Occipital Ctx | 55.9 |
| Control (Path) 3 Hippo | 3.4 | Control 1 Occipital Ctx | 1.1 |
| AD 1 Temporal Ctx | 15.1 | Control 2 Occipital Ctx | 40.6 |
| AD 2 Temporal Ctx | 30.4 | Control 3 Occipital Ctx | 12.1 |
| AD 3 Temporal Ctx | 4.7 | Control 4 Occipital Ctx | 5.6 |
| AD 4 Temporal Ctx | 25.9 | Control (Path) 1 Occipital Ctx | 59.5 |
| AD 5 Inf Temporal Ctx | 100.0 | Control (Path) 2 Occipital Ctx | 5.5 |
| AD 5 SupTemporal Ctx | 35.4 | Control (Path) 3 Occipital Ctx | 0.7 |
| AD 6 Inf Temporal Ctx | 28.5 | Control (Path) 4 Occipital Ctx | 6.0 |
| AD 6 Sup Temporal Ctx | 23.7 | Control 1 Parietal Ctx | 5.2 |
| Control 1 Temporal Ctx | 3.4 | Control 2 Parietal Ctx | 37.4 |
| Control 2 Temporal Ctx | 48.6 | Control 3 Parietal Ctx | 14.3 |
| Control 3 Temporal Ctx | 13.4 | Control (Path) 1 Parietal Ctx | 59.5 |
| Control 4 Temporal Ctx | 6.5 | Control (Path) 2 Parietal Ctx | 16.6 |
| Control (Path) 1 Temporal Ctx | 77.9 | Control (Path) 3 Parietal Ctx | 2.3 |
| Control (Path) 2 Temporal Ctx | 37.6 | Control (Path) 4 Parietal Ctx | 27.0 |

TABLE EC

Panel 1.3D

| Tissue Name | Rel. Exp. (%) Ag2844, Run 167819099 | Tissue Name | Rel. Exp. (%) Ag2844, Run 167819099 |
|---|---|---|---|
| Liver adenocarcinoma | 0.0 | Kidney (fetal) | 1.3 |
| Pancreas | 0.3 | Renal ca. 786-0 | 0.2 |
| Pancreatic ca. CAPAN 2 | 0.0 | Renal ca. A498 | 4.1 |
| Adrenal gland | 1.2 | Renal ca. RXF 393 | 16.7 |
| Thyroid | 0.2 | Renal ca. ACHN | 28.5 |
| Salivary gland | 0.5 | Renal ca. UO-31 | 0.4 |
| Pituitary gland | 0.0 | Renal ca. TK-10 | 0.0 |
| Brain (fetal) | 68.3 | Liver | 0.0 |
| Brain (whole) | 80.1 | Liver (fetal) | 0.0 |
| Brain (amygdala) | 43.5 | Liver ca. (hepatoblast) HepG2 | 0.0 |
| Brain (cerebellum) | 44.8 | Lung | 0.0 |
| Brain (hippocampus) | 42.6 | Lung (fetal) | 0.9 |
| Brain (substantia nigra) | 34.4 | Lung ca. (small cell) LX-1 | 0.0 |
| Brain (thalamus) | 63.7 | Lung ca. (small cell) NCI-H69 | 7.8 |
| Cerebral Cortex | 100.0 | Lung ca. (s.cell var.) SHP-77 | 0.0 |
| Spinal cord | 17.2 | Lung ca. (large cell)NCI-H460 | 0.0 |
| glio/astro U87-MG | 0.0 | Lung ca. (non-sm. cell) A549 | 2.3 |
| glio/astro U-118-MG | 2.8 | Lung ca. (non-s.cell) NCI-H23 | 0.0 |
| astrocytoma SW1783 | 10.6 | Lung ca. (non-s.cell) HOP-62 | 1.2 |
| neuro*; met SK-N-AS | 2.1 | Lung ca. (non-s.cl) NCI-H522 | 0.0 |
| astrocytoma SF-539 | 0.2 | Lung ca. (squam.) SW 900 | 0.0 |
| astrocytoma SNB-75 | 1.0 | Lung ca. (squam.) NCI-H596 | 23.8 |
| glioma SNB-19 | 2.4 | Mammary gland | 0.6 |
| glioma U251 | 6.8 | Breast ca.* (pl.ef) MCF-7 | 0.0 |
| glioma SF-295 | 0.0 | Breast ca.* (pl.ef) MDA-MB-231 | 0.0 |
| Heart (fetal) | 1.2 | Breast ca.* (pl.ef) T47D | 0.0 |
| Heart | 0.7 | Breast ca. BT-549 | 0.0 |
| Skeletal muscle (fetal) | 0.5 | Breast ca. MDA-N | 0.0 |
| Skeletal muscle | 0.5 | Ovary | 0.0 |
| Bone marrow | 0.0 | Ovarian ca. OVCAR-3 | 0.0 |
| Thymus | 0.0 | Ovarian ca. OVCAR-4 | 0.0 |
| Spleen | 0.0 | Ovarian ca. OVCAR-5 | 5.6 |
| Lymph node | 0.3 | Ovarian ca. OVCAR-8 | 0.0 |
| Colorectal | 0.4 | Ovarian ca. IGROV-1 | 0.0 |
| Stomach | 0.0 | Ovarian ca.* (ascites) SK-OV-3 | 0.0 |
| Small intestine | 1.3 | Uterus | 0.0 |
| Colon ca. SW480 | 0.0 | Placenta | 0.0 |
| Colon ca.* SW620(SW480 met) | 0.0 | Prostate | 0.2 |
| Colon ca. HT29 | 0.0 | Prostate ca.* (bone met)PC-3 | 0.0 |
| Colon ca. HCT-116 | 0.0 | Testis | 0.0 |
| Colon ca. CaCo-2 | 0.0 | Melanoma Hs688(A).T | 7.9 |
| Colon ca. tissue(ODO3866) | 0.5 | Melanoma* (met) Hs688(B).T | 2.6 |
| Colon ca. HCC-2998 | 0.0 | Melanoma UACC-62 | 0.0 |
| Gastric ca.* (liver met) NCI-N87 | 0.0 | Melanoma M14 | 0.0 |
| Bladder | 0.2 | Melanoma LOX IMVI | 0.0 |
| Trachea | 0.0 | Melanoma* (met) SK-MEL-5 | 0.0 |
| Kidney | 0.0 | Adipose | 0.6 |

TABLE ED

Panel 4D

| Tissue Name | Rel. Exp. (%) Ag2844, Run 164299480 | Tissue Name | Rel. Exp. (%) Ag2844, Run 164299480 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular | 0.0 |

TABLE ED-continued

Panel 4D

| Tissue Name | Rel. Exp. (%) Ag2844, Run 164299480 | Tissue Name | Rel. Exp. (%) Ag2844, Run 164299480 |
|---|---|---|---|
| Primary Th2 act | 0.0 | EC TNFalpha + IL-1beta Microvascular Dermal EC none | 0.0 |
| Primary Tr1 act | 0.0 | Microvascular Dermal EC TNFalpha + IL-1beta | 0.0 |
| Primary Th1 rest | 0.0 | Bronchial epithelium TNFalpha + IL1beta | 0.0 |
| Primary Th2 rest | 0.0 | Small airway epithelium none | 0.0 |
| Primary Tr1 rest | 0.0 | Small airway epithelium TNFalpha + IL-1beta | 0.0 |
| CD45RA CD4 lymphocyte act | 43.5 | Coronery artery SMC rest | 1.7 |
| CD45RO CD4 lymphocyte act | 0.0 | Coronery artery SMC TNFalpha + IL-1beta | 5.1 |
| CD8 lymphocyte act | 0.0 | Astrocytes rest | 2.0 |
| Secondary CD8 lymphocyte rest | 0.0 | Astrocytes TNF alpha + IL-1beta | 3.7 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratino-cytes) none | 0.0 |
| LAK cells rest | 0.0 | CCD1106 (Keratinocytes) TNFalpha + IL-1beta | 0.0 |
| LAK cells IL-2 | 0.0 | Liver cirrhosis | 0.3 |
| LAK cells IL-2 + IL-12 | 0.0 | Lupus kidney | 0.0 |
| LAK cells IL-2 + IFN gamma | 0.0 | NCI-H292 none | 1.8 |
| LAK cells IL-2 + IL-18 | 0.0 | NCI-H292 IL-4 | 27.2 |
| LAK cells PMA/ionomycin | 0.0 | NCI-H292 IL-9 | 3.7 |
| NK Cells IL-2 rest | 0.0 | NCI-H292 IL-13 | 17.8 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 0.0 | Lung fibroblast none | 4.3 |
| PBMC PWM | 0.0 | Lung fibroblast TNF alpha + IL-1beta | 3.4 |
| PBMC PHA-L | 0.0 | Lung fibroblast IL-4 | 12.5 |
| Ramos (B cell) none | 0.0 | Lung fibroblast IL-9 | 2.6 |
| Ramos (B cell) ionomycin | 0.0 | Lung fibroblast IL-13 | 5.3 |
| B lymphocytes PWM | 0.0 | Lung fibroblast IFN gamma | 5.2 |
| B lymphocytes CD40L and IL-4 | 0.0 | Dermal fibroblast CCD1070 rest | 90.1 |
| EOL-1 dbcAMP | 0.0 | Dermal fibroblast CCD1070 TNF alpha | 100.0 |
| EOL-1 dbcAMP PMA/ionomycin | 0.0 | Dermal fibroblast CCD1070 IL-1beta | 39.8 |
| Dendritic cells none | 0.0 | Dermal fibroblast IFN gamma | 1.6 |
| Dendritic cells LPS | 0.0 | Dermal fibroblast IL-4 | 4.5 |
| Dendritic cells anti-CD40 | 0.0 | IBD Colitis 2 | 0.0 |
| Monocytes rest | 0.0 | IBD Crohn's | 0.2 |
| Monocytes LPS | 0.0 | Colon | 1.3 |
| Macrophages rest | 0.0 | Lung | 0.0 |
| Macrophages LPS | 0.0 | Thymus | 0.4 |
| HUVEC none | 0.0 | Kidney | 0.5 |
| HUVEC starved | 0.0 | | |

TABLE EF

Panel CNS_1

| Tissue Name | Rel. Exp. (%) Ag2844, Run 171669549 | Tissue Name | Rel. Exp. (%) Ag2844, Run 171669549 |
|---|---|---|---|
| BA4 Control | 27.4 | BA17 PSP | 23.7 |
| BA4 Control2 | 37.9 | BA17 PSP2 | 8.0 |
| BA4 Alzheimer's2 | 9.8 | Sub Nigra Control | 36.3 |
| BA4 Parkinson's | 32.1 | Sub Nigra Control2 | 49.7 |
| BA4 Parkinson's2 | 33.2 | Sub Nigra Alzheimer's2 | 10.7 |
| BA4 Huntington's | 28.7 | Sub Nigra Parkinson's2 | 56.3 |
| BA4 Huntington's2 | 8.8 | Sub Nigra Huntington's | 66.4 |
| BA4 PSP | 6.3 | Sub Nigra Huntington's2 | 17.0 |
| BA4 PSP2 | 15.2 | Sub Nigra PSP2 | 7.6 |
| BA4 Depression | 18.9 | Sub Nigra Depression | 5.4 |
| BA4 Depression2 | 6.4 | Sub Nigra Depression2 | 6.4 |
| BA7 Control | 58.6 | Glob Palladus Control | 20.3 |
| BA7 Control2 | 18.7 | Glob Palladus Control2 | 34.9 |
| BA7 Alzheimer's2 | 6.4 | Glob Palladus Alzheimer's | 10.2 |
| BA7 Parkinson's | 18.8 | Glob Palladus Alzheimer's2 | 9.6 |
| BA7 Parkinson's2 | 44.1 | Glob Palladus Parkinson's | 100.0 |
| BA7 Huntington's | 66.9 | Glob Palladus Parkinson's2 | 25.9 |
| BA7 Huntington's2 | 25.2 | Glob Palladus PSP | 3.7 |
| BA7 PSP | 48.6 | Glob Palladus PSP2 | 14.5 |
| BA7 PSP2 | 34.2 | Glob Palladus Depression | 9.7 |
| BA7 Depression | 6.3 | Temp Pole Control | 14.9 |
| BA9 Control | 29.3 | Temp Pole Control2 | 60.7 |
| BA9 Control2 | 87.1 | Temp Pole Alzheimer's | 4.7 |
| BA9 Alzheimer's | 4.5 | Temp Pole Alzheimer's2 | 5.0 |
| BA9 Alzheimer's2 | 14.1 | Temp Pole Parkinson's | 28.5 |
| BA9 Parkinson's | 39.0 | Temp Pole Parkinson's2 | 30.4 |
| BA9 Parkinson's2 | 36.3 | Temp Pole Huntington's | 45.1 |
| BA9 Huntington's | 48.0 | Temp Pole PSP | 0.0 |
| BA9 Huntington's2 | 12.4 | Temp Pole PSP2 | 5.4 |
| BA9 PSP | 13.6 | Temp Pole Depression2 | 5.2 |
| BA9 PSP2 | 2.9 | Cing Gyr Control | 0.0 |
| BA9 Depression | 10.1 | Cing Gyr Control2 | 36.6 |
| BA9 Depression2 | 8.2 | Cing Gyr Alzheimer's | 15.3 |

TABLE EF-continued

Panel CNS_1

| Tissue Name | Rel. Exp. (%) Ag2844, Run 171669549 | Tissue Name | Rel. Exp. (%) Ag2844, Run 171669549 |
|---|---|---|---|
| BA17 Control | 28.7 | Cing Gyr Alzheimer's2 | 9.9 |
| BA17 Control2 | 50.3 | Cing Gyr Parkinson's | 47.6 |
| BA17 Alzheimer's2 | 5.3 | Cing Gyr Parkinson's2 | 40.1 |
| BA17 Parkinson's | 26.2 | Cing Gyr Huntington's | 58.6 |
| BA17 Parkinson's2 | 23.2 | Cing Gyr Huntington's2 | 21.9 |
| BA17 Huntington's | 24.7 | Cing Gyr PSP | 11.6 |
| BA17 Huntington's2 | 6.6 | Cing Gyr PSP2 | 3.9 |
| BA17 Depression | 4.7 | Cing Gyr Depression | 8.0 |
| BA17 Depression2 | 26.2 | Cing Gyr Depression2 | 22.4 |

CNS_neurodegeneration_v1.0 Summary: Ag2844 While this panel shows no specific Alzheimer's association with the CG55784-01 gene, these results confirm expression of this gene in the brain. See Panel 1.3D for discussion of utility of this gene in the brain.

Panel 1.3D Summary: Ag2844 Highly brain-preferential expression of the CG55784-01 gene indicates a specific role for this gene product in the brain. This gene encodes a protein that is homologous to a neural cell adhesion molecule (NCAM). NCAM related proteins, such as Nr-CAM, play a critical role in neurite extension. Therefore, the introduction of ligands specific for this gene product, such as contactin, in directed brain regions may have utility in fostering focal neurite outgrowth. This may have utility in therapeutically countering neurite degeneration of neurodegenerative diseases such as Alzheimer's, ataxias, and Parkinson's disease.

In addition, the expression of this gene is relatively high in the normal brain samples compared to the cancer cell lines derived from brain cancer. Hence, expression of this gene can be used as a marker to differentiate between normal and cancerous tissue. There are also significantly higher levels of expression in renal cancer cell lines compared to a normal kidney sample. Therefore, expression of this gene may also be used as a marker in renal cancer.

Panel 2.2 Summary: Ag2844 Expression of the CG55784-01 gene is low/undetectable in all samples on this panel (CTs>35). (Data not shown.)

Panel 4D Summary: Ag2844 The CG55784-01 transcript is induced in IL-4 and IL-13 treated NCI-H292 cells, expressed constitutively in a dermal fibroblast cell line and appears to be slightly induced by IL-4 in lung fibroblasts. CD45RA (naive) T cells also express the transcript. The transcript encodes an NCAM-like molecule. Based on the expression pattern of the transcript, the homology to NCAM protein, and the regulation of transcript expression by IL-4 and IL-13, therapeutics designed with the protein encoded for by this transcript may be important in the treatment of asthma and COPD.

Panel CNS_1 Summary: Ag2844 Expression in this panel further confirms widespread brain expression of the CG55784-01 gene. Please see Panel 1.3D for discussion of utility of this gene in the brain.

F. CG55916-01: Phospholipase (NOV6)

Expression of gene CG55916-01 was assessed using the primer-probe set Ag2843, described in Table FA. Results of the RTQ-PCR runs are shown in Tables FB, FC, FD, FE, and FF.

TABLE FA

Probe Name Ag2843

| Primers | Sequences | Start Position | SEQ ID NO |
|---|---|---|---|
| Forward | 5'-accaatggatccactcctatct-3' | 544 | 290 |
| Probe | TET-5'-ctgactccaaccaggacagcaagatg-3'-TAMRA | 574 | 291 |
| Reverse | 5'-attctcagcaggctcttgatct-3' | 610 | 292 |

TABLE FB

CNS_neurodegeneration_v1.0

| Tissue Name | Rel. Exp. (%) Ag2843, Run 209058882 | Tissue Name | Rel. Exp. (%) Ag2843, Run 209058882 |
|---|---|---|---|
| AD 1 Hippo | 16.6 | Control (Path) 3 Temporal Ctx | 11.0 |
| AD 2 Hippo | 33.2 | Control (Path) 4 Temporal Ctx | 35.4 |
| AD 3 Hippo | 10.3 | AD 1 Occipital Ctx | 15.9 |
| AD 4 Hippo | 29.9 | AD 2 Occipital Ctx (Missing) | 0.3 |
| AD 5 Hippo | 38.4 | AD 3 Occipital Ctx | 11.2 |
| AD 6 Hippo | 100.0 | AD 4 Occipital Ctx | 19.8 |
| Control 2 Hippo | 30.6 | AD 5 Occipital Ctx | 20.7 |
| Control 4 Hippo | 48.6 | AD 6 Occipital Ctx | 18.6 |
| Control (Path) 3 Hippo | 9.5 | Control 1 Occipital Ctx | 9.2 |
| AD 1 Temporal Ctx | 24.1 | Control 2 Occipital Ctx | 34.2 |
| AD 2 Temporal Ctx | 20.0 | Control 3 Occipital Ctx | 17.1 |
| AD 3 Temporal Ctx | 8.8 | Control 4 Occipital Ctx | 18.2 |
| AD 4 Temporal Ctx | 12.1 | Control (Path) 1 Occipital Ctx | 45.1 |
| AD 5 Inf Temporal Ctx | 37.4 | Control (Path) 2 Occipital Ctx | 18.3 |
| AD 5 Sup Temporal Ctx | 38.7 | Control (Path) 3 Occipital Ctx | 6.7 |
| AD 6 Inf | 64.2 | Control (Path) 4 | 21.6 |

TABLE FB-continued

CNS_neurodegeneration_v1.0

| Tissue Name | Rel. Exp. (%) Ag2843, Run 209058882 | Tissue Name | Rel. Exp. (%) Ag2843, Run 209058882 |
|---|---|---|---|
| AD 6 Sup Temporal Ctx | 59.0 | Occipital Ctx Control 1 Parietal Ctx | 13.8 |
| Control 1 Temporal Ctx | 7.0 | Control 2 Parietal Ctx | 33.9 |
| Control 2 Temporal Ctx | 16.7 | Control 3 Parietal Ctx | 11.9 |
| Control 3 Temporal Ctx | 11.7 | Control (Path) 1 Parietal Ctx | 30.1 |
| Control 3 Temporal Ctx | 25.9 | Control (Path) 2 Parietal Ctx | 18.9 |
| Control (Path) 1 Temporal Ctx | 26.6 | Control (Path) 3 Parietal Ctx | 9.0 |
| Control (Path) 2 Temporal Ctx | 23.5 | Control (Path) 4 Parietal Ctx | 40.6 |

TABLE FC

Panel 1.3D

| Tissue Name | Rel. Exp. (%) Ag2843, Run 161560324 | Rel. Exp. (%) Ag2843, Run 165721033 | Tissue Name | Rel. Exp. (%) Ag2843, Run 161560324 | Rel. Exp. (%) Ag2843, Run 165721033 |
|---|---|---|---|---|---|
| Liver adenocarcinoma | 74.2 | 65.1 | Kidney (fetal) | 4.7 | 3.1 |
| Pancreas | 0.4 | 1.4 | Renal ca. 786-0 | 6.6 | 7.6 |
| Pancreatic ca. CAPAN 2 | 18.2 | 49.7 | Renal ca. A498 | 39.2 | 56.3 |
| Adrenal gland | 5.1 | 12.4 | Renal ca. RXF 393 | 1.9 | 9.3 |
| Thyroid | 3.8 | 5.4 | Renal ca. ACHN | 19.5 | 39.0 |
| Salivary gland | 0.5 | 2.0 | Renal ca. UO-31 | 16.4 | 30.6 |
| Pituitary gland | 1.9 | 6.2 | Renal ca. TK-10 | 7.4 | 8.4 |
| Brain (fetal) | 2.3 | 9.3 | Liver | 0.0 | 0.9 |
| Brain (whole) | 9.3 | 23.3 | Liver (fetal) | 0.1 | 0.8 |
| Brain (amygdala) | 16.5 | 29.7 | Liver ca. (hepatoblast) HepG2 | 12.6 | 33.2 |
| Brain (cerebellum) | 9.7 | 25.0 | Lung | 2.2 | 5.0 |
| Brain (hippocampus) | 22.4 | 41.8 | Lung (fetal) | 1.4 | 2.2 |
| Brain (substantia nigra) | 4.4 | 16.5 | Lung ca. (small cell) LX-1 | 19.8 | 84.1 |
| Brain (thalamus) | 17.3 | 54.0 | Lung ca. (small cell) NCI-H69 | 0.2 | 0.4 |
| Cerebral Cortex | 40.6 | 18.7 | Lung ca. (s. cell var.) SHP-77 | 0.8 | 0.7 |
| Spinal cord | 46.7 | 58.6 | Lung ca. (large cell)NCI-H460 | 14.3 | 59.0 |
| glio/astro U87-MG | 13.2 | 9.0 | Lung ca. (non-sm. cell) A549 | 16.7 | 28.1 |
| glio/astro U-118-MG | 6.7 | 34.2 | Lung ca. (non-s. cell) NCI-H23 | 2.1 | 1.8 |
| astrocytoma SW1783 | 16.7 | 17.7 | Lung ca. (non-s. cell) HOP-62 | 10.8 | 27.9 |
| neuro*; met SK-N-AS | 7.6 | 21.5 | Lung ca. (non s. cl) NCI-H522 | 11.3 | 13.0 |
| astrocytoma SF-539 | 7.7 | 11.8 | Lung ca. (squam.) SW 900 | 1.0 | 0.2 |

TABLE FC-continued

Panel 1.3D

| Tissue Name | Rel. Exp. (%) Ag2843, Run 161560324 | Rel. Exp. (%) Ag2843, Run 165721033 | Tissue Name | Rel. Exp. (%) Ag2843, Run 161560324 | Rel. Exp. (%) Ag2843, Run 165721033 |
|---|---|---|---|---|---|
| astrocytoma SNB-75 | 4.1 | 18.2 | Lung ca. (squam.) NCI-H596 | 0.3 | 0.3 |
| glioma SNB-19 | 19.3 | 24.3 | Mammary gland | 4.4 | 6.2 |
| glioma U251 | 7.4 | 21.6 | Breast ca.* (pl. ef) MCF-7 | 5.6 | 11.2 |
| glioma SF-295 | 23.3 | 26.6 | Breast ca.* (pl. ef) MDA-MB-231 | 13.2 | 52.9 |
| Heart (fetal) | 24.5 | 9.0 | Breast ca.* (pl. ef) T47D | 7.5 | 15.3 |
| Heart | 17.3 | 15.4 | Breast ca. BT-549 | 2.6 | 11.0 |
| Skeletal muscle (fetal) | 100.0 | 20.0 | Breast ca. MDA-N | 2.3 | 2.6 |
| Skeletal muscle | 61.6 | 100.0 | Ovary | 31.6 | 7.5 |
| Bone marrow | 0.2 | 0.9 | Ovarian ca. OVCAR-3 | 32.1 | 68.3 |
| Thymus | 2.6 | 0.4 | Ovarian ca. OVCAR-4 | 7.9 | 39.0 |
| Spleen | 1.4 | 1.4 | Ovarian ca. OVCAR-5 | 17.0 | 36.6 |
| Lymph node | 0.7 | 1.7 | Ovarian ca. OVCAR-8 | 29.9 | 24.1 |
| Colorectal | 36.9 | 18.8 | Ovarian ca. IGROV-1 | 4.7 | 6.8 |
| Stomach | 4.2 | 13.0 | Ovarian ca.* (ascites) SK-OV-3 | 47.0 | 99.3 |
| Small intestine | 2.4 | 8.9 | Uterus | 2.9 | 15.1 |
| Colon ca. SW480 | 15.9 | 28.9 | Placenta | 6.5 | 6.6 |
| Colon ca.* SW620(SW480 met) | 14.9 | 16.8 | Prostate | 4.8 | 5.2 |
| Colon ca. HT29 | 38.4 | 17.2 | Prostate ca.* (bone met)PC-3 | 27.5 | 86.5 |
| Colon ca. HCT-116 | 15.1 | 28.1 | Testis | 12.3 | 17.3 |
| Colon ca. CaCo-2 | 25.2 | 19.6 | Melanoma Hs688(A).T | 8.8 | 3.5 |
| Colon ca. tissue(ODO3866) | 37.9 | 26.1 | Melanoma* (met) Hs688(B).T | 14.4 | 15.6 |
| Colon ca. HCC-2998 | 15.6 | 20.3 | Melanoma UACC-62 | 1.9 | 6.5 |
| Gastric ca.* (liver met) NCI-N87 | 44.4 | 62.4 | Melanoma M14 | 1.0 | 7.5 |
| Bladder | 8.9 | 6.3 | Melanoma LOX IMVI | 6.0 | 9.0 |
| Trachea | 11.5 | 13.8 | Melanoma* (met) SK-MEL-5 | 1.3 | 3.7 |
| Kidney | 4.1 | 2.4 | Adipose | 4.6 | 5.6 |

TABLE FD

Panel 2D

| Tissue Name | Rel. Exp. (%) Ag2843, Run 161590185 | Tissue Name | Rel. Exp. (%) Ag2843, Run 161590185 | Tissue Name | Rel. Exp. (%) Ag2843, Run 161590185 | Tissue Name | Rel. Exp. (%) Ag2843, Run 161590185 |
|---|---|---|---|---|---|---|---|
| Normal Colon | 70.7 | Kidney Margin 8120608 | 4.3 | | | 8120614 | |
| CC Well to Mod Diff (ODO3866) | 30.6 | Kidney Cancer 8120613 | 1.0 | CC Gr.2 rectosigmoid (ODO3868) | 17.1 | Kidney Cancer 9010320 | 18.6 |
| CC Margin (ODO3866) | 30.6 | Kidney Margin | 7.3 | CC Margin (ODO3868) | 5.9 | Kidney Margin 9010321 | 11.4 |

TABLE FD-continued

Panel 2D

| Tissue Name | Rel. Exp. (%) Ag2843, Run 161590185 | Tissue Name | Rel. Exp. (%) Ag2843, Run 161590185 |
|---|---|---|---|
| CC Mod Diff (OD03920) | 12.7 | Normal Uterus | 6.0 |
| CC Margin (OD03920) | 48.0 | Uterus Cancer 064011 | 6.7 |
| CC Gr.2 ascend colon (OD03921) | 31.4 | Normal Thyroid | 7.4 |
| CC Margin (OD03921) | 19.8 | Thyroid Cancer 064010 | 66.9 |
| CC from Partial Hepatectomy (OD04309) Mets | 17.8 | Thyroid Cancer A302152 | 19.5 |
| Liver Margin (OD04309) | 0.3 | Thyroid Margin A302153 | 4.8 |
| Colon mets to lung (OD04451-01) | 15.0 | Normal Breast | 11.7 |
| Lung Margin (OD04451-02) | 4.6 | Breast Cancer (OD04566) | 0.2 |
| Normal Prostate 6546-1 | 6.2 | Breast Cancer (OD04590-01) | 59.5 |
| Prostate Cancer (OD04410) | 6.3 | Breast Cancer Mets (OD04590-03) | 33.2 |
| Prostate Margin (OD04410) | 9.6 | Breast Cancer Metastasis (OD04655-05) | 14.4 |
| Prostate Cancer (OD04720-01) | 18.2 | Breast Cancer 064006 | 6.7 |
| Prostate Margin (OD04720-02) | 16.7 | Breast Cancer 1024 | 14.5 |
| Normal Lung 061010 | 8.1 | Breast Cancer 9100266 | 9.9 |
| Lung Met to Muscle (OD04286) | 17.7 | Breast Margin 9100265 | 6.0 |
| Muscle Margin (OD04286) | 32.1 | Breast Cancer A209073 | 10.4 |
| Lung Malignant Cancer (OD03126) | 12.2 | Breast Margin A2090734 | 16.3 |
| Lung Margin (OD03126) | 7.3 | Normal Liver | 1.4 |
| Lung Cancer (OD04404) | 7.6 | Liver Cancer 064003 | 0.6 |
| Lung Margin (OD04404) | 12.2 | Liver Cancer 1025 | 0.6 |
| Lung Cancer (OD04565) | 16.0 | Liver Cancer 1026 | 2.3 |
| Lung Margin (OD04565) | 7.9 | Liver Cancer 6004-T | 1.0 |
| Lung Cancer (OD04237-01) | 0.6 | Live Tissue 6004-N | 2.3 |
| Lung Margin (OD04237-02) | 6.3 | Liver Cancer 6005-T | 3.1 |
| Ocular Mel Met to Liver (OD04310) | 7.5 | Live Tissue 6005-N | 0.2 |
| Liver Margin (OD04310) | 0.3 | Normal Bladder | 10.6 |
| Melanoma Mets to Lung (OD04321) | 3.3 | Bladder Cancer 1023 | 13.4 |
| Lung Margin (OD04321) | 15.0 | Bladder Cancer A302173 | 3.2 |
| Normal Kidney | 7.6 | Bladder Cancer (OD04718-01) | 27.7 |
| Kidney Ca, Nuclear grade 2 (OD04338) | 26.6 | Bladder Normal Adjacent (OD04718-03) | 15.0 |
| Kidney Margin (OD04338) | 8.1 | Normal Ovary | 11.7 |
| Kidney Ca Nuclear grade 1/2 (OD04339) | 100.0 | Ovarian Cancer 064008 | 73.2 |
| Kidney Margin (OD04339) | 6.7 | Ovarian Cancer (OD04768-07) | 4.8 |
| Kidney Ca, Clear cell type (OD04340) | 26.6 | Ovary Margin (OD04768-08) | 8.1 |
| Kidney Margin (OD04340) | 11.4 | Normal Stomach | 26.4 |
| Kidney Ca, Nuclear grade 3 (OD04348) | 7.7 | Gastric Cancer 9060358 | 4.1 |
| Kidney Margin (OD04348) | 7.3 | Stomach Margin 9060359 | 13.1 |
| Kidney Cancer (OD04622-01) | 21.0 | Gastric Cancer 9060395 | 24.3 |
| Kidney Margin (OD04622-03) | 3.0 | Stomach Margin 9060394 | 25.3 |
| Kidney Cancer (OD04450-01) | 21.2 | Gastric Cancer 9060397 | 57.8 |
| Kidney Margin (OD04450-03) | 5.6 | Stomach Margin 9060396 | 36.9 |
| Kidney Cancer 8120607 | 42.3 | Gastric Cancer 064005 | 25.7 |

TABLE FE

Panel 4D

| Tissue Name | Rel. Exp. (%) Ag2843, Run 159616571 | Tissue Name | Rel. Exp. (%) Ag2843, Run 159616571 |
|---|---|---|---|
| Secondary Th1 act | 0.6 | HUVEC IL-1beta | 3.8 |
| Secondary Th2 act | 1.1 | HUVEC IFN gamma | 5.1 |
| Secondary Tr1 act | 0.6 | HUVEC TNF alpha + IFN gamma | 1.4 |
| Secondary Th1 rest | 0.2 | HUVEC TNF alpha + IL4 | 2.6 |
| Secondary Th2 rest | 0.2 | HUVEC IL-11 | 5.6 |
| Secondary Tr1 rest | 0.5 | Lung Microvascular EC none | 18.4 |
| Primary Th1 act | 1.7 | Lung Microvascular EC TNFalpha + IL-1beta | 6.1 |
| Primary Th2 act | 2.4 | Microvascular Dermal EC none | 19.6 |
| Primary Tr1 act | 0.0 | Microsvascular Dermal EC TNFalpha + IL-1beta | 6.3 |
| Primary Th1 rest | 0.3 | Bronchial epithelium TNFalpha + IL1beta | 9.9 |
| Primary Th2 rest | 1.4 | Small airway epithelium none | 20.7 |
| Primary Tr1 rest | 0.3 | Small airway epithelium TNFalpha + IL-1beta | 100.0 |
| CD45RA CD4 lymphocyte act | 6.3 | Coronery artery SMC rest | 6.1 |
| CD45RO CD4 lymphocyte act | 1.7 | Coronery artery SMC TNFalpha + IL-1beta | 3.2 |
| CD8 lymphocyte act | 1.3 | Astrocytes rest | 30.1 |
| Secondary CD8 lymphocyte rest | 0.6 | Astrocytes TNFalpha + IL-1beta | 22.7 |
| Secondary CD8 lymphocyte act | 0.4 | KU-812 (Basophil) rest | 0.6 |
| CD4 lymphocyte none | 0.2 | KU-812 (Basophil) PMA/ionomycin | 2.6 |
| 2ry Th1/Th2/Tr1_anti-CD95 CH11 | 0.0 | CCD1106 (Keratinocytes) none | 27.7 |
| LAK cells rest | 0.3 | CCD1106 (Keratinocytes) TNFalpha + IL-1beta | 4.9 |
| LAK cells IL-2 | 0.9 | Liver cirrhosis | 1.1 |
| LAK cells | 0.9 | Lupus kidney | 2.3 |

TABLE FE-continued

Panel 4D

| Tissue Name | Rel. Exp. (%) Ag2843, Run 159616571 | Tissue Name | Rel. Exp. (%) Ag2843, Run 159616571 |
|---|---|---|---|
| IL-2 + IL-12 LAK cells IL-2 + IFN gamma | 0.3 | NCI-H292 none | 48.3 |
| LAK cells IL-2 + IL-18 | 0.2 | NCI-H292 IL-4 | 57.8 |
| LAK cells PMA/ionomycin | 0.7 | NCI-H292 IL-9 | 69.3 |
| NK Cells IL-2 rest | 0.7 | NCI-H292 IL-13 | 47.0 |
| Two Way MLR 3 day | 0.6 | NCI-H292 IFN gamma | 42.6 |
| Two Way MLR 5 day | 0.4 | HPAEC none | 13.7 |
| Two Way MLR 7 day | 0.7 | HPAEC TNF alpha + IL-1beta | 2.1 |
| PBMC rest | 1.2 | Lung fibroblast none | 32.3 |
| PBMC PWM | 2.9 | Lung fibroblast TNF alpha + IL-1beta | 10.1 |
| PBMC PHA-L | 0.7 | Lung fibroblast IL-4 | 31.9 |
| Ramos (B cell) none | 0.4 | Lung fibroblast IL-9 | 32.3 |
| Ramos (B cell) ionomycin | 1.1 | Lung fibroblast IL-13 | 24.0 |
| B lymphocytes PWM | 2.7 | Lung fibroblast IFN gamma | 37.4 |
| B lymphocytes CD40L and IL-4 | 0.6 | Dermal fibroblast CCD1070 rest | 18.2 |
| EOL-1 dbcAMP | 1.9 | Dermal fibroblast CCD1070 TNF alpha | 12.9 |
| EOL-1 dbcAMP PMA/ionomycin | 8.6 | Dermal fibroblast CCD1070 IL-1beta | 9.9 |
| Dendritic cells none | 0.0 | Dermal fibroblast IFN gamma | 29.9 |
| Dendritic cells LPS | 0.1 | Dermal fibroblast IL-4 | 36.1 |
| Dendritic cells anti-CD40 | 0.8 | IBD Colitis 2 | 1.3 |
| Monocytes rest | 0.7 | IBD Crohn's | 0.8 |
| Monocytes LPS | 0.4 | Colon | 5.4 |
| Macrophages rest | 1.3 | Lung | 5.2 |
| Macrophages LPS | 0.3 | Thymus | 6.7 |
| HUVEC none | 11.1 | Kidney | 2.3 |
| HUVEC starved | 15.2 | | |

TABLE FF

Panel 5D

| Tissue Name | Rel. Exp. (%) Ag2843, Run 170221175 | Tissue Name | Rel. Exp. (%) Ag2843, Run 170221175 |
|---|---|---|---|
| 97457_Patient-02go_adipose | 26.6 | 94709_Donor 2 AM - A_adipose | 19.5 |
| 97476_Patient-07sk_skeletal muscle | 5.5 | 94710_Donor 2 AM - B_adipose | 10.3 |
| 97477_Patient-07ut_uterus | 14.0 | 94711_Donor 2 AM - C_adipose | 6.3 |
| 97478_Patient-07pl_placenta | 17.4 | 94712_Donor 2 AD - A_adipose | 39.5 |
| 97481_Patient-08sk_skeletal muscle | 4.4 | 94713_Donor 2 AD - B_adipose | 37.1 |
| 97482_Patient-08ut_uterus | 14.8 | 94714_Donor 2 AD - C_adipose | 28.3 |
| 97483_Patient-08pl_placenta | 15.3 | 94742_Donor 3 U - A_Mesenchymal Stem Cells | 18.8 |
| 97486_Patient-09sk_skeletal muscle | 8.4 | 94743_Donor 3 U - B_Mesenchymal Stem Cells | 24.5 |
| 97487_Patient-09ut_uterus | 9.3 | 94730_Donor 3 AM - A_adipose | 34.4 |
| 97488_Patient-09pl_placenta | 11.0 | 94731_Donor 3 AM - B_adipose | 18.8 |
| 97492_Patient-10ut_uterus | 9.7 | 94732_Donor 3 AM - C_adipose | 20.0 |
| 97493_Patient-10pl_placenta | 24.3 | 94733_Donor 3 AD - A_adipose | 28.5 |
| 97495_Patient-11go_adipose | 7.5 | 94734_Donor 3 AD - B_adipose | 17.2 |
| 97496_Patient-11sk_skeletal muscle | 27.4 | 94735_Donor 3 AD - C_adipose | 23.3 |
| 97497_Patient-11ut_uterus | 27.0 | 77138_Liver_HepG2untreated | 71.7 |
| 97498_Patient-11pl_placenta | 16.4 | 73556_Heart_Cardiac stromal cells (primary) | 29.5 |
| 97500_Patient-12go_adipose | 21.5 | 81735_Small Intestine | 4.6 |
| 97501_Patient-12sk_skeletal muscle | 40.9 | 72409_Kidney_Proximal Convoluted Tubule | 14.9 |
| 97502_Patient-12ut_uterus | 25.2 | 82685_Small intestine_Duodenum | 1.6 |
| 97503_Patient-12pl_placenta | 9.2 | 90650_Adrenal_Adrenocortical adenoma | 12.2 |
| 94721_Donor 2 U - A_Mesenchymal Stem Cells | 26.4 | 72410_Kidney_HRCE | 100.0 |
| 94722_Donor 2 U - B_Mesenchymal Stem Cells | 21.3 | 72411_Kidney_HRE | 79.0 |
| 94723_Donor 2 U - C_Mesenchymal Stem Cells | 20.3 | 73139_Uterus_Uterine smooth muscle cells | 22.4 |

CNS_neurodegeneration_v1.0 Summary: Ag2843 While no specific association between Alzheimer's disease and the CG55916-01 gene is detected in this panel, these results confirm expression of this gene in the brain. See Panel 1.3D for discussion of utility of this gene in the central nervous system.

Panel 1.3D Summary: Ag2743 Two experiments both show highest expression of the CG55916-01 gene in both fetal and adult skeletal muscle (CTs=27–28). This gene encodes a protein that is homologous to a phosphoinositol-specific (PI) phospholipase. It has moderate expression in a variety of metabolic tissues including pancreas, adrenal, thyroid, pituitary, adult and fetal heart, adult and fetal liver, and adipose. PI-specific phospholipases are responsible for the generation of the second messengers diacylglycerol and inositol triphosphate, which promote the activation of protein kinase C and the release of Ca++ from intracellular stores, respectively. Given the myriad roles that these second messengers play in cellular metabolism, it is that selective inhibition of this gene product through the application of a small molecule therapeutic may be useful in the treatment of metabolic disease, including Types 1 and 2 diabetes, and obesity.

In addition, all the cancer cell lines on this panel express this gene, suggesting that this gene plays an important role in proliferating cells. There is increased expression in some colon, kidney, lung, breast, ovary, prostate and pancreatic cancer cell lines compared to the normal tissues suggesting that this gene can be used as a marker to differentiate malignant and normal tissue.

Furthermore, expression of this gene in the brain supports abundant literature documenting an important and broad role for PLC in neurons. Dysregulation of PLC in the brain of schizophrenics suggests that specific modulators of this gene product may have utility in damping and thus influencing schizophrenia. Decreased PLC enzymatic activity in Alzheimer's disease suggests that agents that specifically induce the activity of the protein encoded by this gene may also have utility in treating Alzheimer's disease.

Panel 2D Summary: Ag2843 The CG55916-01 gene encodes a putative member of the phospholipase family and is moderately expressed in all tissues on this panel. The highest expression is seen in a kidney cancer sample (CT=26.8). There are significantly higher level of expression in thyroid, kidney and metastatic breast cancers compared to normal adjacent tissues. These data indicate that the expression of this gene might be associated with these forms of cancer and that therapeutic modulation of this gene using small molecule inhibitors might be of use in the treatment of these cancers.

G. CG55802-01: 3 ALPHA-HYDROXYSTEROID DEHYDROGENASE-LIKE (NOV7)

Expression of gene CG55802-01 was assessed using the primer-probe set Ag2624, described in Table GA.

TABLE GA

Probe Name Ag2624

| Primers | Sequences | Start Position | SEQ ID NO |
|---|---|---|---|
| Forward | 5'-ttgagttgactccagaggacat-3' | 887 | 293 |
| Probe | TET-5'-attgatggcctcaacagaaatctccg-3'-TAMRA | 916 | 294 |
| Reverse | 5'-ccagcaagactgaagaaagaaa-3' | 947 | 295 |

CNS_neurodegeneration_v1.0 Summary: Ag2624 Expression of the CG55802-01 gene is low/undetected in all the samples in this panel (CT>35). The amp plot suggests that there is a high probability of a probe failure.

Panel 1.3D Summary: Ag2624 Expression of the CG55802-01 gene is low/undetected in all the samples in this panel (CT>35). The amp plot suggests that there is a high probability of a probe failure.

Panel 4D Summary: Ag2624 Expression of the CG55802-01 gene is low/undetected in all the samples in this panel (CT>35). The amp plot suggests that there is a high probability of a probe failure.

H. CG55906-01: S3-12 (NOV19)

Expression of gene CG55906-01 was assessed using the primer-probe set Ag2840, described in Table HA. Results of the RTQ-PCR runs are shown in Tables HB, HC, HD, HE, HF and HG.

TABLE HA

Probe Name Ag2840

| Primers | Sequences | Start Position | SEQ ID NO |
|---|---|---|---|
| Forward | 5'-tctatggtcatgggtacgaaag-3' | 1190 | 296 |
| Probe | TET-5'-acacgatgtccactgggctcacag-3'-TAMRA | 1212 | 297 |
| Reverse | 5'-gttgtgttcagcccagtttg-3' | 1265 | 298 |

Panel 4D Summary: Ag2843 The CG55916-01 transcript is expressed in most tissues on this panel, but is highly expressed in activated small airway epithelium (CT=25.8). The transcript encodes a putative protein involved in signal transduction. Designing protein therapeutics that inhibit the expression of the transcript or the function of the protein could be important in the treatment of inflammatory diseases, and particularly ones that involve the small airway epithelium such as asthma.

Panel 5D Summary: Ag2843 The CG55916-01 gene is moderately expressed in adipose, placenta, and skeletal muscle, results that are consistent with the expression in Panel 1.3D. This gene is also expressed in human mesenchymal stem cells that can be differentiated in vitro into adipocytes, chondrocytes and osteocytes. Thus, this gene product may be a small molecule target for the treatment of disease in bone, cartilage, and adipose.

TABLE HB

| | Panel 1.3D | | |
|---|---|---|---|
| Tissue Name | Rel. Exp. (%) Ag2840, Run 161922468 | Tissue Name | Rel. Exp. (%) Ag2840, Run 161922468 |
| Liver adenocarcinoma | 0.5 | Kidney (fetal) | 1.6 |
| Pancreas | 0.3 | Renal ca. 786-0 | 0.1 |
| Pancreatic ca. CAPAN 2 | 0.2 | Renal ca. A498 | 0.2 |
| Adrenal gland | 0.6 | Renal ca. RXF 393 | 0.0 |
| Thyroid | 0.8 | Renal ca. ACHN | 0.0 |
| Salivary gland | 0.6 | Renal ca. UO-31 | 0.0 |
| Pituitary gland | 0.3 | Renal ca. TK-10 | 0.0 |
| Brain (fetal) | 0.0 | Liver | 0.4 |
| Brain (whole) | 0.2 | Liver (fetal) | 0.9 |
| Brain (amygdala) | 0.6 | Liver ca. | 0.6 |

TABLE HB-continued

Panel 1.3D

| Tissue Name | Rel. Exp. (%) Ag2840, Run 161922468 | Tissue Name | Rel. Exp. (%) Ag2840, Run 161922468 |
|---|---|---|---|
| Brain (cerebellum) | 0.2 | (hepatoblast) HepG2 | |
| Brain (hippocampus) | 0.6 | Lung | 0.3 |
| Brain (substantia nigra) | 0.1 | Lung (fetal) | 0.2 |
| Brain (thalamus) | 0.2 | Lung ca. (small cell) LX-1 | 0.1 |
| Cerebral Cortex | 2.1 | Lung ca. (small cell) NCI-H69 | 0.0 |
| Spinal cord | 0.8 | Lung ca. (s. cell var.) SHP-77 | 0.1 |
| glio/astro U87-MG | 0.0 | Lung ca. (large cell)NCI-H460 | 0.0 |
| glio/astro U-118-MG | 0.1 | Lung ca. (non-sm. cell) A549 | 0.1 |
| astrocytoma SW1783 | 0.1 | Lung ca. (non-s. cell) NCI-H23 | 0.0 |
| neuro*; met SK-N-AS | 0.0 | Lung ca. (non-s. cell) HOP-62 | 0.0 |
| astrocytoma SF-539 | 0.2 | Lung ca. (non-s. cl) NCI-H522 | 0.1 |
| astrocytoma SNB-75 | 0.1 | Lung ca. (squam.) SW 900 | 0.1 |
| glioma SNB-19 | 0.0 | Lung ca. (squam.) NCI-H596 | 0.0 |
| glioma U251 | 0.1 | Mammary gland | 18.4 |
| glioma SF-295 | 0.2 | Breast ca.* (pl. ef) MCF-7 | 0.1 |
| Heart (fetal) | 1.0 | Breast ca.* (pl. ef) MDA-MB-231 | 0.0 |
| Heart | 11.8 | Breast ca.* (pl. ef) T47D | 0.2 |
| Skeletal muscle (fetal) | 100.0 | Breast ca. BT-549 | 0.0 |
| Skeletal muscle | 32.8 | Breast ca. MDA-N | 0.0 |
| Bone marrow | 0.4 | Ovary | 2.9 |
| Thymus | 3.5 | Ovarian ca. OVCAR-3 | 0.2 |
| Spleen | 0.4 | Ovarian ca. OVCAR-4 | 0.1 |
| Lymph node | 0.7 | Ovarian ca. OVCAR-5 | 0.4 |
| Colorectal | 6.7 | Ovarian ca. OVCAR-8 | 0.3 |
| Stomach | 1.0 | Ovarian ca. IGROV-1 | 0.0 |
| Small intestine | 2.7 | Ovarian ca.* (ascites) SK-OV-3 | 0.0 |
| Colon ca. SW480 | 0.0 | Uterus | 1.5 |
| Colon ca.* SW620(SW480 met) | 0.1 | Placenta | 0.0 |
| Colon ca. HT29 | 0.4 | Prostate | 0.5 |
| Colon ca. HCT-116 | 0.1 | Prostate ca.* (bone met)PC-3 | 1.7 |
| Colon ca. CaCo-2 | 0.0 | Testis | 0.6 |
| Colon ca. tissue(ODO3866) | 6.4 | Melanoma Hs688(A).T | 0.0 |
| Colon Ca. HCC-2998 | 0.1 | Melanoma* (met) Hs688(B).T | 0.0 |
| Gastric ca.* (liver met) NCI-N87 | 0.8 | Melanoma UACC-62 | 0.0 |
| Bladder | 3.3 | Melanoma M14 | 0.0 |
| Trachea | 3.2 | Melanoma LOX IMVI | 0.0 |
| Kidney | 0.9 | Melanoma* (met) SK-MEL-5 | 0.0 |
|  |  | Adipose | 87.1 |

TABLE HC

Panel 2D

| Tissue Name | Rel. Exp. (%) Ag2840, Run 161922469 | Tissue Name | Rel. Exp. (%) Ag2840, Run 161922469 |
|---|---|---|---|
| Normal Colon | 41.8 | Kidney Margin 8120608 | 0.2 |
| CC Well to Mod Diff (ODO3866) | 4.3 | Kidney Cancer 8120613 | 0.7 |
| CC Margin (ODO3866) | 6.9 | Kidney Margin 8120614 | 2.0 |
| CC Gr.2 rectosigmoid (ODO3868) | 1.1 | Kidney Cancer 9010320 | 8.4 |
| CC Margin (ODO3868) | 4.5 | Kidney Margin 9010321 | 2.0 |
| CC Mod Diff (ODO3920) | 0.0 | Normal Uterus | 2.4 |
| CC Margin (ODO3920) | 0.0 | Uterus Cancer 064011 | 4.4 |
| CC Gr.2 ascend colon (ODO3921) | 0.4 | Normal Thyroid | 2.3 |
| CC Margin (ODO3921) | 2.5 | Thyroid Cancer 064010 | 0.0 |
| CC from Partial Hepatectomy (ODO4309) Mets | 0.2 | Thyroid Cancer A302152 | 0.4 |
| Liver Margin (ODO4309) | 1.8 | Thyroid Margin A302153 | 0.5 |
| Colon mets to lung (OD04451-01) | 0.1 | Normal Breast | 80.7 |
| Lung Margin (OD04451-02) | 0.1 | Breast Cancer (OD04566) | 1.5 |
| Normal Prostate 6546-1 | 0.9 | Breast Cancer (OD04590-01) | 21.0 |
| Prostate Cancer (OD04410) | 1.2 | Breast Cancer Mets (OD04590-03) | 100.0 |
| Prostate Margin (OD04410) | 3.2 | Breast Cancer Metastasis (OD04655-05) | 13.3 |
| Prostate Cancer (OD04720-01) | 0.8 | Breast Cancer 064006 | 0.9 |
| Prostate Margin (OD04720-02) | 1.9 | Breast Cancer 1024 | 5.8 |
| Normal Lung 061010 | 1.4 | Breast Cancer 9100266 | 3.2 |
| Lung Met to Muscle (ODO4286) | 0.5 | Breast Margin 9100265 | 5.9 |
| Muscle Margin (ODO4286) | 16.4 | Breast Cancer A209073 | 2.0 |
| Lung Malignant Cancer (OD03126) | 0.1 | Breast Margin A2090734 | 7.9 |
| Lung Margin (OD03126) | 0.4 | Normal Liver | 3.3 |
| Lung Cancer (OD04404) | 0.3 | Liver Cancer 064003 | 2.2 |
| Lung Margin (OD04404) | 0.3 | Liver Cancer 1025 | 6.0 |
| Lung Cancer (OD04565) | 0.0 | Liver Cancer 1026 | 2.0 |
| Lung Margin (OD04565) | 0.2 | Liver Cancer 6004-T | 7.5 |
| Lung Cancer (OD04237-01) | 0.0 | Liver Tissue 6004-N | 2.2 |
| Lung Margin (OD04237-02) | 0.1 | Liver Cancer 6005-T | 1.8 |
| Ocular Mel Met to Liver (ODO4310) | 0.4 | Liver Tissue 6005-N | 0.3 |
| Liver Margin (ODO4310) | 2.6 | Normal Bladder | 6.0 |
| Melanoma Mets to Lung (OD04321) | 0.0 | Bladder Cancer 1023 | 0.7 |
| Lung Margin (OD04321) | 0.2 | Bladder Cancer A302173 | 0.4 |
| Normal Kidney | 3.1 | Bladder Cancer (OD04718-01) | 0.1 |

TABLE HC-continued

Panel 2D

| Tissue Name | Rel. Exp. (%) Ag2840, Run 161922469 | Tissue Name | Rel. Exp. (%) Ag2840, Run 161922469 |
| --- | --- | --- | --- |
| Kidney Ca, Nuclear grade 2 (OD04338) | 0.0 | Bladder Normal Adjacent (OD04718-03) | 11.7 |
| Kidney Margin (OD04338) | 0.0 | Normal Ovary | 0.8 |
| Kidney Ca Nuclear grade 1/2 (OD04339) | 0.2 | Ovarian Cancer 064008 | 1.1 |
| Kidney Margin (OD04339) | 1.1 | Ovarian Cancer (OD04768-07) | 0.7 |
| Kidney Ca, Clear cell type (OD04340) | 0.3 | Ovary Margin (OD04768-08) | 2.9 |
| Kidney Margin (OD04340) | 1.8 | Normal Stomach | 15.1 |
| Kidney Ca, Nuclear grade 3 (OD04348) | 0.0 | Gastric Cancer 9060358 | 6.4 |
| Kidney Margin (OD04348) | 1.3 | Stomach Margin 9060359 | 2.0 |
| Kidney Cancer (OD04622-01) | 0.0 | Gastric Cancer 9060395 | 8.8 |
| Kidney Margin (OD04622-03) | 0.0 | Stomach Margin 9060394 | 8.4 |
| Kidney Cancer (OD04450-01) | 0.1 | Gastric Cancer 9060397 | 0.9 |
| Kidney Margin (OD04450-03) | 1.2 | Stomach Margin 9060396 | 3.1 |
| Kidney Cancer 8120607 | 0.1 | Gastric Cancer 064005 | 5.3 |

TABLE HD

Panel 3D

| Tissue Name | Rel. Exp. (%) Ag2840, Run 170190088 | Tissue Name | Rel. Exp. (%) Ag2840, Run 170190088 |
| --- | --- | --- | --- |
| Daoy-Medulloblastoma | 22.1 | Ca Ski-Cervical epidermoid carcinoma (metastasis) | 7.6 |
| TE671-Medulloblastoma | 10.1 | ES-2-Ovarian clear cell carcinoma | 0.0 |
| D283 Med-Medulloblastoma | 2.3 | Ramos-Stimulated with PMA/ionomycin 6 h | 0.0 |
| PFSK-1-Primitive Neuroectodermal | 6.2 | Ramos-Stimulated with PMA/ionomycin 14 h | 0.0 |
| XF-498-CNS | 8.4 | MEG-01-Chronic myelogenous leukemia (megokaryoblast) | 0.0 |
| SNB-78-Glioma | 5.0 | Raji-Burkitt's lymphoma | 0.0 |
| SF-268-Glioblastoma | 1.4 | Daudi-Burkitt's lymphoma | 0.0 |
| T98G-Glioblastoma | 0.0 | U266-B-cell plasmacytoma | 10.4 |
| SK-N-SH-Neuroblastoma (metastasis) | 2.7 | CA46-Burkitt's lymphoma | 0.0 |
| SF-295-Glioblastoma | 2.9 | RL-non-Hodgkin's B-cell lymphoma | 5.9 |
| Cerebellum | 3.4 | JM1-pre-B-cell lymphoma | 7.8 |
| Cerebellum | 38.2 | Jurkat-T cell leukemia | 2.7 |
| NCI-H292-Mucoepidermoid lung carcinoma | 0.0 | TF-1-Erythroleukemia | 5.0 |
| DMS-114-Small cell lung cancer | 0.0 | HUT 78-T-cell lymphoma | 0.0 |
| DMS-79-Small cell lung cancer | 100.0 | U937-Histiocytic lymphoma | 11.0 |
| NCI-H146-Small cell lung cancer | 0.0 | KU-812-Myelogenous leukemia | 31.0 |
| NCI-H526-Small cell lung cancer | 9.6 | 769-P-Clear cell renal carcinoma | 6.1 |
| NCI-N417-Small cell lung cancer | 0.0 | Caki-2-Clear cell renal carcinoma | 3.0 |
| NCI-H82-Small cell lung cancer | 3.3 | SW 839-Clear cell renal carcinoma | 0.0 |
| NCI-H157-Squamous cell lung cancer (metastasis) | 0.0 | G401-Wilms' tumor | 3.7 |
| NCI-H1155-Large cell lung cancer | 20.6 | Hs766T-Pancreatic carcinoma (LN metastasis) | 9.8 |
| NCI-H1299-Large cell lung cancer | 9.2 | CAPAN-1-Pancreatic adenocarcinoma (liver metastasis) | 0.0 |
| NCI-H727-Lung carcinoid | 0.0 | SU86.86-Pancreatic carcinoma (liver metastasis) | 5.0 |
| NCI-UMC-11-Lung carcinoid | 0.0 | BxPC-3-Pancreatic adenocarcinoma | 13.0 |
| LX-1-Small cell lung cancer | 7.9 | HPAC-Pancreatic adenocarcinoma | 20.7 |
| Colo-205-Colon cancer | 0.0 | MIA PaCa-2-Pancreatic carcinoma | 4.2 |
| KM12-Colon cancer | 0.0 | CFPAC-1-Pancreatic ductal adenocarcinoma | 13.9 |
| KM20L2-Colon cancer | 2.9 | PANC-1-Pancreatic epithelioid ductal carcinoma | 69.7 |
| NCI-H716-Colon cancer | 0.0 | T24-Bladder carcinma (transitional cell) | 0.0 |
| SW-48-Colon adenocarcinoma | 0.0 | 5637-Bladder carcinoma | 0.0 |
| SW1116-Colon adenocarcinoma | 0.0 | HT-1197-Bladder carcinoma | 6.4 |
| LS 174T-Colon adenocarcinoma | 0.0 | UM-UC-3-Bladder carcinma (transitional cell) | 2.4 |
| SW-948-Colon adenocarcinoma | 0.0 | A204-Rhabdomyo-sarcoma | 12.5 |
| SW-480-Colon adenocarcinoma | 3.8 | HT-1080-Fibro-sarcoma | 12.1 |
| NCI-SNU-5-Gastric carcinoma | 2.1 | MG-63-Osteosarcoma | 0.0 |
| KATO III-Gastric carcinoma | 12.0 | SK-LMS-1-Leiomyo-sarcoma (vulva) | 16.7 |
| NCI-SNU-16-Gastric carcinoma | 5.8 | SJRH30-Rhabdo-myosarcoma (met to bone marrow) | 5.7 |
| NCI-SNU-1-Gastric carcinoma | 2.6 | A431-Epidermoid carcinoma | 0.0 |
| RF-1-Gastric adenocarcinoma | 0.0 | WM266-4-Melanoma | 0.0 |
| RF-48-Gastric adenocarcinoma | 7.2 | DU 145-Prostate carcinoma (brain metastasis) | 0.0 |
| MKN-45-Gastric carcinoma | 96.6 | MDA-MB-468-Breast adenocarcinoma | 11.4 |
| NCI-N87-Gastric carcinoma | 10.0 | SCC-4-Squamous cell carcinoma of tongue | 0.0 |
| OVCAR-5-Ovarian carcinoma | 3.7 | SCC-9-Squamous cell carcinoma of tongue | 0.0 |
| RL95-2-Uterine | 7.2 | SCC-15-Squamous | 0.0 |

TABLE HD-continued

Panel 3D

| Tissue Name | Rel. Exp. (%) Ag2840, Run 170190088 | Tissue Name | Rel. Exp. (%) Ag2840, Run 170190088 |
|---|---|---|---|
| carcinoma | | cell carcinoma of tongue | |
| HelaS3-Cervical adenocarcinoma | 0.0 | CAL 27-Squamous cell carcinoma of tongue | 0.0 |

TABLE HE

Panel 4.1D

| Tissue Name | Rel. Exp. (%) Ag2840, Run 204964146 | Tissue Name | Rel. Exp. (%) Ag2840, Run 204964146 |
|---|---|---|---|
| Secondary Th1 act | 6.4 | HUVEC IL-1beta | 0.9 |
| Secondary Th2 act | 2.0 | HUVEC IFN gamma | 4.0 |
| Secondary Tr1 act | 4.0 | HUVEC TNF alpha + IFN gamma | 0.0 |
| Secondary Th1 rest | 4.4 | HUVEC TNF alpha + IL4 | 5.4 |
| Secondary Th2 rest | 13.9 | HUVEC IL-11 | 3.8 |
| Secondary Tr1 rest | 8.2 | Lung Microvascular EC none | 8.4 |
| Primary Th1 act | 3.0 | Lung Microvascular EC TNFalpha + IL-1beta | 4.0 |
| Primary Th2 act | 9.6 | Microvascular Dermal EC none | 4.5 |
| Primary Tr1 act | 1.6 | Microvasular Dermal EC TNFalpha + IL-1beta | 0.0 |
| Primary Th1 rest | 3.2 | Bronchial epithelium TNFalpha + IL1beta | 10.4 |
| Primary Th2 rest | 5.6 | Small airway epithelium none | 5.9 |
| Primary Tr1 rest | 6.4 | Small airway epithelium TNFalpha + IL-1beta | 8.5 |
| CD45RA CD4 lymphocyte act | 6.0 | Coronery artery SMC rest | 0.0 |
| CD45RO CD4 lymphocyte act | 6.2 | Coronery artery SMC TNFalpha + IL-1beta | 1.0 |
| CD8 lymphocyte act | 6.4 | Astrocytes rest | 0.0 |
| Secondary CD8 lymphocyte rest | 2.4 | Astrocytes TNFalpha + IL-1beta | 1.4 |
| Secondary CD8 lymphocyte act | 0.0 | KU-812 (Basophil) rest | 8.4 |
| CD4 lymphocyte none | 12.5 | KU-812 (Basophil) PMA/ionomycin | 6.1 |
| 2ry Th1/Th2/Tr1_anti-CD95 CH11 | 11.3 | CCD1106 (Keratinocytes) none | 6.7 |
| LAK cells rest | 7.6 | CCD1106 (Keratinocytes) TNFalpha + IL-1beta | 1.8 |
| LAK cells IL-2 | 4.2 | Liver cirrhosis | 63.3 |
| LAK cells IL-2 + IL-12 | 1.9 | NCI-H292 none | 0.0 |
| LAK cells IL-2 + IFN gamma | 2.7 | NCI-H292 IL-4 | 0.0 |
| LAK cells IL-2+ IL-18 | 6.6 | NCI-H292 IL-9 | 0.0 |
| LAK cells PMA/ionomycin | 0.0 | NCI-H292 IL-13 | 0.0 |
| NK Cells IL-2 rest | 3.4 | NCI-H292 IFN gamma | 0.0 |
| Two Way MLR 3 day | 6.7 | HPAEC none | 0.0 |
| Two Way MLR 5 day | 5.8 | HPAEC TNF alpha + IL-1beta | 3.3 |
| Two Way MLR 7 day | 8.5 | Lung fibroblast none | 29.5 |
| PBMC rest | 9.3 | Lung fibroblast TNF alpha + IL-1beta | 8.2 |
| PBMC PWM | 1.0 | Lung fibroblast IL-4 | 7.9 |
| PBMC PHA-L | 3.2 | Lung fibroblast IL-9 | 10.3 |
| Ramos (B cell) none | 1.9 | Lung fibroblast IL-13 | 4.2 |
| Ramos (B cell) ionomycin | 3.0 | Lung fibroblast IFN gamma | 9.1 |
| B lymphocytes PWM | 1.0 | Dermal fibroblast CCD1070 rest | 2.3 |
| B lymphocytes CD40L and IL-4 | 9.4 | Dermal fibroblast CCD1070 TNF alpha | 9.2 |
| EOL-1 dbcAMP | 0.8 | Dermal fibroblast CCD1070 IL-1beta | 4.9 |
| EOL-1 dbcAMP PMA/ionomycin | 6.0 | Dermal fibroblast IFN gamma | 1.0 |
| Dendritic cells none | 0.9 | Dermal fibroblast IL-4 | 8.1 |
| Dendritic cells LPS | 0.0 | Dermal Fibroblasts rest | 4.2 |
| Dendritic cells anti-CD40 | 3.1 | Neutrophils TNFa+LPS | 25.0 |
| Monocytes rest | 13.8 | Neutrophils rest | 66.9 |
| Monocytes LPS | 4.9 | Colon | 100.0 |
| Macrophages rest | 2.1 | Lung | 3.8 |
| Macrophages LPS | 0.9 | Thymus | 24.5 |
| HUVEC none | 6.3 | Kidney | 32.1 |
| HUVEC starved | 7.9 | | |

TABLE HF

Panel 4D

| Tissue Name | Rel. Exp. (%) Ag2840, Run 159843516 | Tissue Name | Rel. Exp. (%) Ag2840, Run 159843516 |
|---|---|---|---|
| Secondary Th1 act | 2.0 | HUVEC IL-1beta | 0.2 |
| Secondary Th2 act | 1.8 | HUVEC IFN gamma | 0.9 |
| Secondary Tr1 act | 0.5 | HUVEC TNF alpha + IFN gamma | 0.3 |
| Secondary Th1 rest | 1.4 | HUVEC TNF alpha + IL4 | 0.0 |
| Secondary Th2 rest | 1.3 | HUVEC IL-11 | 0.0 |
| Secondary Tr1 rest | 1.3 | Lung Microvascular EC none | 1.0 |
| Primary Th1 act | 0.5 | Lung Microvascular EC TNFalpha + IL-1beta | 0.4 |
| Primary Th2 act | 1.1 | Microvascular Dermal EC none | 0.4 |
| Primary Tr1 act | 1.0 | Microsvasular Dermal EC TNFalpha + IL-1beta | 0.0 |
| Primary Th1 rest | 2.9 | Bronchial epithelium TNFalpha + IL1beta | 0.2 |
| Primary Th2 rest | 1.1 | Small airway epithelium none | 1.5 |
| Primary Tr1 rest | 1.4 | Small airway epithelium TNF alpha + IL-1beta | 9.2 |
| CD45RA CD4 lymphocyte act | 0.5 | Coronery artery SMC rest | 0.3 |

TABLE HF-continued

Panel 4D

| Tissue Name | Rel. Exp. (%) Ag2840, Run 159843516 | Tissue Name | Rel. Exp. (%) Ag2840, Run 159843516 |
|---|---|---|---|
| CD45RO CD4 lymphocyte act | 0.7 | Coronery artery SMC TNFalpha + IL-1beta | 0.0 |
| CD8 lymphocyte act | 0.3 | Astrocytes rest | 0.3 |
| Secondary CD8 lymphocyte rest | 0.6 | Astrocytes TNFalpha + IL-1beta | 0.0 |
| Secondary CD8 lymphocyte act | 0.2 | KU-812 (Basophil) rest | 1.6 |
| CD4 lymphocyte none | 1.5 | KU-812 (Basophil) PMA/ionomycin | 2.5 |
| 2ry Th1/Th2/Tr1_anti-CD95 CH11 | 1.1 | CCD1106 (Keratinocytes) none | 0.6 |
| LAK cells rest | 1.3 | CCD1106 (Keratinocytes) TNFalpha + IL-1beta | 0.0 |
| LAK cells IL-2 | 2.2 | Liver cirrhosis | 9.6 |
| LAK cells IL-2 + IL-12 | 1.0 | Lupus kidney | 1.9 |
| LAK cells IL-2 + IFN gamma | 1.0 | NCI-H292 none | 0.0 |
| LAK cells IL-2 + IL-18 | 0.7 | NCI-H292 IL-4 | 0.0 |
| LAK cells PMA/ionomycin | 0.3 | NCI-H292 IL-9 | 0.0 |
| NK Cells IL-2 rest | 1.1 | NCI-H292 IL-13 | 0.0 |
| Two Way MLR 3 day | 1.0 | NCI-H292 IFN gamma | 0.0 |
| Two Way MLR 5 day | 0.4 | HPAEC none | 0.1 |
| Two Way MLR 7 day | 0.2 | HPAEC TNF alpha + IL-1beta | 0.6 |
| PBMC rest | 1.3 | Lung fibroblast none | 5.0 |
| PBMC PWM | 1.2 | Lung fibroblast TNF alpha + IL-1beta | 0.8 |
| PBMC PHA-L | 1.2 | Lung fibroblast IL-4 | 1.8 |
| Ramos (B cell) none | 0.2 | Lung fibroblast IL-9 | 1.8 |
| Ramos (B cell) ionomycin | 1.7 | Lung fibroblast IL-13 | 1.2 |
| B lymphocytes PWM | 1.6 | Lung fibroblast IFN gamma | 2.0 |
| B lymphocytes CD40L and IL-4 | 3.2 | Dermal fibroblast CCD1070 rest | 1.1 |
| EOL-1 dbcAMP | 0.1 | Dermal fibroblast CCD1070 TNF alpha | 1.7 |
| EOL-1 dbcAMP PMA/ionomycin | 1.0 | Dermal fibroblast CCD1070 IL-1beta | 0.7 |
| Dendritic cells none | 0.0 | Dermal fibroblast IFN gamma | 0.7 |
| Dendritic cells LPS | 0.2 | Dermal fibroblast IL-4 | 0.2 |
| Dendritic cells anti-CD40 | 0.8 | IBD Colitis 2 | 2.0 |
| Monocytes rest | 2.3 | IBD Crohn's | 8.9 |
| Monocytes LPS | 1.2 | Colon | 100.0 |
| Macrophages rest | 1.3 | Lung | 4.4 |
| Macrophages LPS | 0.0 | Thymus | 16.8 |
| HUVEC none | 0.0 | Kidney | 14.2 |
| HUVEC starved | 1.8 | | |

TABLE HG

Panel 5D

| Tissue Name | Rel. Exp. (%) Ag2840, Run 169270970 | Tissue Name | Rel. Exp. (%) Ag2840, Run 169270970 |
|---|---|---|---|
| 97457_Patient-02go_adipose | 63.3 | 94709_Donor 2 AM - A_adipose | 24.1 |
| 97476_Patient-07sk_skeletal muscle | 15.8 | 94710_Donor 2 AM - B_adipose | 7.9 |
| 97477_Patient-07ut_uterus | 8.8 | 94711_Donor 2 AM - C_adipose | 4.5 |
| 97478_Patient-07pl_placenta | 0.0 | 94712_Donor 2 AD - A_adipose | 18.3 |
| 97481_Patient-08sk_skeletal muscle | 15.7 | 94713_Donor 2 AD - B_adipose | 24.1 |
| 97482_Patient 08ut_uterus | 8.4 | 94714_Donor 2 AD - C_adipose | 23.5 |
| 97483_Patient-08pl_placenta | 0.0 | 94742_Donor 3 U - A_Mesenchymal Stem Cells | 0.0 |
| 97486_Patient-09sk_skeletal muscle | 1.4 | 94743_Donor 3 U - B_Mesenchymal Stem Cells | 0.0 |
| 97487_Patient-09ut_uterus | 5.5 | 94730_Donor 3 AM - A_adipose | 0.0 |
| 97488_Patient-09pl_placenta | 0.0 | 94731_Donor 3 AM - B_adipose | 0.0 |
| 97492_Patient-10ut_uterus | 4.6 | 94732_Donor 3 AM - C_adipose | 0.1 |
| 97493_Patient-10pl_placenta | 0.3 | 94733_Donor 3 AD - A_adipose | 0.0 |
| 97495_Patient-11go_adipose | 0.0 | 94734_Donor 3 AD - B_adipose | 0.0 |
| 97496_Patient-11sk_skeletal muscle | 0.0 | 94735_Donor 3 AD - C_adipose | 0.0 |
| 97497_Patient-11ut_uterus | 0.0 | 77138_Liver HepG2untreated | 1.1 |
| 97498_Patient-11pl_placenta | 0.0 | 73556_Heart_Cardiac stromal cells (primary) | 0.0 |
| 97500_Patient-12go_adipose | 48.0 | 81735_Small Intestine | 16.8 |
| 97501_Patient-12sk_skeletal muscle | 100.0 | 72409_Kidney_Proximal Convoluted Tubule | 0.0 |
| 97502_Patient-12ut_uterus | 18.7 | 82685_Small intestine_Duodenum | 0.7 |
| 97503_Patient-12pl_placenta | 0.0 | 90650_Adrenal_Adrenocortical adenoma | 0.1 |
| 94721_Donor 2 U - A_Mesenchymal Stem Cells | 0.0 | 72410_Kidney_HRCE | 0.0 |
| 94722_Donor 2 U - B_Mesenchymal Stem Cells | 0.2 | 72411_Kidney_HRE | 0.0 |
| 94723_Donor 2 U - C_Mesenchymal Stem Cells | 0.0 | 73139_Uterus_Uterine smooth muscle cells | 0.2 |

Panel 1.3D Summary: Ag2840 Highest expression of the CG55906-01 gene is seen in fetal and adult skeletal muscle (CTs=26–28). This gene encodes a putative adipose cell membrane-associated protein that may be upregulated during adipocyte differentiation. Due to its homology with adipophilins, it is possible that this gene product may be involved in lipid uptake. Inhibiting the action of this gene product with an antibody may therefore potentially reduce white adipose mass by limiting lipid uptake and thereby inhibiting adipose expansion. The expression in skeletal muscle may indicate that this gene product can also take up lipids in skeletal muscle. Since excess lipid storage in muscle is associated with insulin resistance, antibody inhibition of this gene product could also be a treatment for the prevention of obesity-associated insulin resistance.

Furthermore, this gene product is also moderately expressed in a variety of metabolic tissues, including pancreas, adrenal, thyroid, pituitary, adult and fetal heart, and adult and fetal liver. Thus, this gene product may also be an antibody target for the treatment of metabolic disease, including Types 1 and 2 diabetes, and obesity.

Overall, this gene is expressed at moderate levels in normal tissues but at significantly lower levels in cancer cell lines on this panel. Thus, this gene product may have a role in homeostasis of normal tissue but not in cancer cell lines.

In addition, moderate but significant expression in the cerebral cortex suggests that the protein encoded by this gene plays a role in lipid processing in the brain. LDLR has been implicated in the development of Alzheimer's disease. Therefore, inhibitors of this gene product may have utility in influencing the development of Alzheimer's disease.

Panel 2D Summary: Ag2840 The CG55906-01 gene is moderately expressed in all tissue samples in panel 2. There is increased expression in normal kidney, colon and bladder samples when compared to the corresponding adjacent tumor tissue. This preferential expression in normal tissues is also seen in Panel 1.3D. Thus, expression of this gene could be used to differentiate between normal and cancerous tissues. Furthermore, therapeutic modulation of the expression of this gene might be of use in the treatment of kidney, colon and bladder cancer.

Panel 3D Summary: Ag2840 The CG55906-01 gene is expressed at a low level in the cancer cell lines on this panel. Significant expression is seen in lung cancer, pancreatic cancer and a leukemia cell line. Thus, the expression of this gene could be used to distinguish samples from these cell lines from other samples on this panel. Furthermore, therapeutic modulation of the expression of this gene might be of use in treating the cancers that are used in the derivation of these cell lines.

Panel 4.1D Summary: Ag2840 The CG55906-01 transcript is expressed in colon and in resting neutrophils (CTs=31–33). The colon expression is consistent with panels 4D, 2.2 and 1.3. Thus, the transcript or the protein it encodes could be used to detect colon tissue and neutrophils.

Panel 4D Summary: Ag2840 The CG55906-01 transcript is expressed in colon and in resting neutrophils. Colon expression is consistent in panel 4D, 2.2 and 1.3. The colon expression is consistent with panels 4D, 2.2 and 1.3. Thus, the transcript or the protein it encodes could be used to detect colon tissue and neutrophils. In addition, the level of expression of this gene is reduced in colon tissue from patients with colitis or Crohn's disease. This suggests that designing therapeutics with the protein encoded for by this transcript could be important for the treatment of IBD.

Panel 5D Summary: Ag2840 The CG55906-01 gene is moderately expressed in clinical specimens of adipose, skeletal muscle and uterus. This confirms expression of this gene in tissues with metabolic function. See Panel 1.3D for discussion of utility of this gene in metabolic disease.

I. CG55778-01 (NOV16a) and CG55778-05 (NOV16e): Aldose Reductase

Expression of gene CG55778-01 and variant CG55778-05 was assessed using the primer-probe set Ag2599, described in Table IA. Results of the RTQ-PCR runs are shown in Tables IB, IC, and ID.

TABLE IA

Probe Name Ag2599

| Primers | Sequences | Start Position | SEQ ID NO |
|---|---|---|---|
| Forward | 5'-gacctgatagacaaccctgtga-3' | 667 | 299 |
| Probe | TET-5'-acggcaagtctcctgctcagattttg-3'-TAMRA | 710 | 300 |
| Reverse | 5'-atcacattcctctggatttgaa-3' | 743 | 301 |

TABLE IB

CNS_neurodegeneration_v1.0

| Tissue Name | Rel. Exp. (%) Ag2599, Run 208779985 | Tissue Name | Rel. Exp. (%) Ag2599, Run 208779985 |
|---|---|---|---|
| AD 1 Hippo | 4.3 | Control (Path) 3 Temporal Ctx | 9.1 |
| AD 2 Hippo | 13.5 | Control (Path) 4 Temporal Ctx | 35.8 |
| AD 3 Hippo | 8.7 | AD 1 Occipital Ctx | 7.0 |
| AD 4 Hippo | 6.8 | AD 2 Occipital Ctx (Missing) | 0.0 |
| AD 5 hippo | 97.3 | AD 3 Occipital Ctx | 13.9 |
| AD 6 Hippo | 27.4 | AD 4 Occipital Ctx | 16.7 |
| Control 2 Hippo | 8.7 | AD 5 Occipital Ctx | 28.7 |
| Control 4 Hippo | 10.8 | AD 6 Occipital Ctx | 22.7 |
| Control (Path) 3 Hippo | 6.6 | Control 1 Occipital Ctx | 10.7 |
| AD 1 Temporal Ctx | 6.4 | Control 2 Occipital Ctx | 19.8 |
| AD 2 Temporal Ctx | 13.1 | Control 3 Occipital Ctx | 17.4 |
| AD 3 Temporal Ctx | 12.5 | Control 4 Occipital Ctx | 6.3 |
| AD 4 Temporal Ctx | 23.8 | Control (Path) 1 Occipital Ctx | 57.8 |
| AD 5 Inf Temporal Ctx | 100.0 | Control (Path) 2 Occipital Ctx | 4.2 |
| AD 5 SupTemporal Ctx | 51.4 | Control (Path) 3 Occipital Ctx | 3.5 |
| AD 6 Inf Temporal Ctx | 43.8 | Control (Path) 4 Occipital Ctx | 11.8 |
| AD 6 Sup Temporal Ctx | 36.1 | Control 1 Parietal Ctx | 13.4 |
| Control 1 Temporal Ctx | 17.6 | Control 2 Parietal Ctx | 50.3 |
| Control 2 Temporal Ctx | 21.9 | Control 3 Parietal Ctx | 19.3 |
| Control 3 Temporal Ctx | 17.8 | Control (Path) 1 Parietal Ctx | 73.2 |
| Control 4 Temporal Ctx | 11.3 | Control (Path) 2 Parietal Ctx | 12.6 |
| Control (Path) 1 Temporal Ctx | 39.2 | Control (Path) 3 Parietal Ctx | 5.7 |

TABLE IB-continued

| | CNS_neurodegeneration_v1.0 | | |
|---|---|---|---|
| Tissue Name | Rel. Exp. (%) Ag2599, Run 208779985 | Tissue Name | Rel. Exp. (%) Ag2599, Run 208779985 |
| Control (Path) 2 Temporal Ctx | 18.7 | Control (Path) 4 Parietal Ctx | 49.7 |

TABLE IC

Panel 1.3D

| Tissue Name | Rel. Exp. (%) Ag2599, Run 162292708 | Rel. Exp. (%) Ag2599, Run 165645365 | Tissue Name | Rel. Exp. (%) Ag2599, Run 162292708 | Rel. Exp. (%) Ag2599, Run 165645365 |
|---|---|---|---|---|---|
| Liver adenocarcinoma | 27.5 | 48.6 | Kidney (fetal) | 0.9 | 0.0 |
| Pancreas | 0.1 | 0.0 | Renal ca. 786-0 | 0.0 | 0.0 |
| Pancreatic ca. CAPAN 2 | 0.3 | 2.4 | Renal ca. A498 | 5.3 | 20.6 |
| Adrenal gland | 0.9 | 1.6 | Renal ca. RXF 393 | 0.0 | 1.6 |
| Thyroid | 1.9 | 2.0 | Renal ca. ACHN | 2.6 | 0.0 |
| Salivary gland | 0.4 | 2.5 | Renal ca. UO-31 | 0.0 | 0.0 |
| Pituitary gland | 1.3 | 0.0 | Renal ca. TK-10 | 0.0 | 0.0 |
| Brain (fetal) | 0.7 | 6.3 | Liver | 0.4 | 0.0 |
| Brain (whole) | 0.5 | 5.6 | Liver (fetal) | 0.3 | 3.7 |
| Brain (amygdala) | 0.3 | 11.3 | Liver ca. (hepatoblast) HepG2 | 0.0 | 0.0 |
| Brain (cerebellum) | 0.7 | 3.4 | Lung | 1.6 | 3.1 |
| Brain (hippocampus) | 2.0 | 11.3 | Lung (fetal) | 0.8 | 2.9 |
| Brain (substantia nigra) | 0.1 | 4.3 | Lung ca. (small cell) LX-1 | 12.7 | 64.2 |
| Brain (thalamus) | 0.4 | 5.3 | Lung ca. (small cell) NCI-H69 | 7.6 | 27.4 |
| Cerebral Cortex | 83.5 | 66.4 | Lung ca. (s.cell var.) SHP-77 | 4.8 | 11.7 |
| Spinal cord | 1.2 | 0.0 | Lung ca. (large cell)NCI-H460 | 0.0 | 0.0 |
| glio/astro U87-MG | 0.5 | 0.0 | Lung ca. (non-sm. cell) A549 | 14.1 | 37.4 |
| glio/astro U-118-MG | 0.0 | 0.0 | Lung ca. (non-s.cell) NCI-H23 | 1.0 | 0.0 |
| astrocytoma SW1783 | 5.2 | 3.0 | Lung ca. (non-s.cell) HOP-62 | 4.5 | 22.2 |
| neuro*; met SK-N-AS | 0.6 | 1.7 | Lung ca. (non-s.cl) NCI-H522 | 20.9 | 39.2 |
| astrocytoma SF-539 | 0.0 | 0.0 | Lung ca. (squam.) SW 900 | 1.0 | 5.9 |
| astrocytoma SNB-75 | 0.0 | 8.8 | Lung ca. (squam.) NCI-H596 | 1.3 | 5.4 |
| glioma SNB-19 | 0.0 | 0.0 | Mammary gland | 4.2 | 5.6 |

TABLE IC-continued

Panel 1.3D

| Tissue Name | Rel. Exp. (%) Ag2599, Run 162292708 | Rel. Exp. (%) Ag2599, Run 165645365 | Tissue Name | Rel. Exp. (%) Ag2599, Run 162292708 | Rel. Exp. (%) Ag2599, Run 165645365 |
|---|---|---|---|---|---|
| glioma U251 | 0.0 | 0.0 | Breast ca.* (pl.ef) MCF-7 | 16.4 | 36.1 |
| glioma SF-295 | 0.0 | 0.0 | Breast ca.* (pl.ef) MDA-MB-231 | 3.3 | 34.4 |
| Heart (fetal) | 100.0 | 97.3 | Breast ca.* (pl.ef) T47D | 4.1 | 2.2 |
| Heart | 1.8 | 10.7 | Breast ca. BT-549 | 1.0 | 17.1 |
| Skeletal muscle (fetal) | 95.3 | 28.3 | Breast ca. MDA-N | 0.0 | 0.0 |
| Skeletal muscle | 1.9 | 22.1 | Ovary | 29.5 | 23.0 |
| Bone marrow | 0.0 | 8.4 | Ovarian ca. OVCAR-3 | 0.8 | 1.8 |
| Thymus | 2.5 | 0.0 | Ovarian ca. OVCAR-4 | 1.0 | 8.2 |
| Spleen | 1.1 | 1.7 | Ovarian ca. OVCAR-5 | 6.0 | 13.5 |
| Lymph node | 0.0 | 12.2 | Ovarian ca OVCAR-8 | 1.9 | 16.4 |
| Colorectal | 10.6 | 4.8 | Ovarian ca. IGROV-1 | 0.0 | 0.0 |
| Stomach | 0.4 | 11.3 | Ovarian ca.* (ascites) SK-OV-3 | 0.5 | 0.0 |
| Small intestine | 0.7 | 6.3 | Uterus | 1.5 | 22.5 |
| Colon ca. SW480 | 3.3 | 18.7 | Placenta | 0.7 | 3.4 |
| Colon ca.* SW620(SW480 met) | 4.2 | 4.8 | Prostate | 0.8 | 1.7 |
| Colon ca. HT29 | 1.2 | 3.1 | Prostate ca.* (bone met)PC-3 | 0.0 | 0.5 |
| Colon ca. HCT-116 | 1.4 | 1.3 | Testis | 35.4 | 100.0 |
| Colon ca. CaCo-2 | 42.9 | 23.5 | Melanoma Hs688(A).T | 5.0 | 2.0 |
| Colon ca. tissue(ODO3866) | 10.6 | 21.5 | Melanoma* (met) Hs688(B).T | 2.1 | 11.7 |
| Colon ca. HCC-2998 | 3.2 | 17.9 | Melanoma UACC-62 | 10.3 | 47.0 |
| Gastric ca.* (liver met) NCI-N87 | 0.0 | 0.0 | Melanoma M14 | 5.6 | 48.6 |
| Bladder | 6.0 | 2.3 | Melanoma LOX IMVI | 3.0 | 1.1 |
| Trachea | 0.8 | 4.2 | Melanoma* (met) SK-MEL-5 | 2.0 | 3.2 |
| Kidney | 0.6 | 0.0 | Adipose | 4.7 | 12.3 |

TABLE ID

Panel 2D

| Tissue Name | Rel. Exp. (%) Ag2599, Run 161921329 | Tissue Name | Rel. Exp. (%) Ag2599, Run 161921329 | Tissue Name | Rel. Exp. (%) Ag2599, Run 161921329 | Tissue Name | Rel. Exp. (%) Ag2599, Run 161921329 |
|---|---|---|---|---|---|---|---|
| Normal Colon | 21.3 | Kidney Margin 8120608 | 16.2 | CC Margin (ODO3868) | 4.7 | Kidney Margin 9010321 | 21.8 |
| CC Well to Mod Diff (ODO3866) | 8.4 | Kidney Cancer 8120613 | 3.6 | CC Mod Diff (ODO3920) | 8.4 | Normal Uterus | 6.3 |
| CC Margin (ODO3866) | 6.2 | Kidney Margin 8120614 | 9.1 | CC Margin (ODO3920) | 7.9 | Uterus Cancer 064011 | 24.5 |
| CC Gr.2 rectosigmoid (ODO3868) | 6.3 | Kidney Cancer 9010320 | 6.1 | CC Gr.2 ascend colon (ODO3921) | 48.6 | Normal Thyroid | 1.3 |
| | | | | CC Margin (ODO3921) | 8.1 | Thyroid Cancer 064010 | 0.3 |

TABLE ID-continued

Panel 2D

| Tissue Name | Rel. Exp. (%) Ag2599, Run 161921329 | Tissue Name | Rel. Exp. (%) Ag2599, Run 161921329 |
|---|---|---|---|
| CC from Partial Hepatectomy (ODO4309) Mets | 28.7 | Thyroid Cancer A302152 | 1.7 |
| Liver Margin (ODO4309) | 6.0 | Thyroid Margin A302153 | 15.9 |
| Colon mets to lung (OD04451-01) | 2.8 | Normal Breast | 18.4 |
| Lung Margin (OD04451-02) | 5.1 | Breast Cancer (OD04566) | 3.0 |
| Normal Prostate 6546-1 | 0.0 | Breast Cancer (OD04590-01) | 14.5 |
| Prostate Cancer (OD04410) | 3.1 | Breast Cancer Mets (OD04590-03) | 21.2 |
| Prostate Margin (OD04410) | 9.2 | Breast Cancer Metastasis (OD04655-05) | 1.9 |
| Prostate Cancer (OD04720-01) | 11.3 | Breast Cancer 064006 | 7.7 |
| Prostate Margin (OD04720-02) | 16.6 | Breast Cancer 1024 | 46.7 |
| Normal Lung 061010 | 22.5 | Breast Cancer 9100266 | 5.8 |
| Lung Met to Muscle (ODO4286) | 54.0 | Breast Margin 9100265 | 5.3 |
| Muscle Margin (ODO4286) | 24.7 | Breast Cancer A209073 | 35.4 |
| Lung Malignant Cancer (OD03126) | 20.7 | Breast Margin A2090734 | 13.8 |
| Lung Margin (OD03126) | 12.4 | Normal Liver | 1.3 |
| Lung Cancer (OD04404) | 18.2 | Liver Cancer 064003 | 0.6 |
| Lung Margin (OD04404) | 7.9 | Liver Cancer 1025 | 1.5 |
| Lung Cancer (OD04565) | 6.8 | Liver Cancer 1026 | 4.1 |
| Lung Margin (OD04565) | 5.7 | Liver Cancer 6004-T | 3.1 |
| Lung Cancer (OD04237-01) | 0.5 | Liver Tissue 6004-N | 1.4 |
| Lung Margin (OD04237-02) | 7.4 | Liver Cancer 6005-T | 3.6 |
| Ocular Mel Met to Liver (ODO4310) | 7.5 | Liver Tissue 6005-N | 0.6 |
| Liver Margin (ODO4310) | 6.6 | Normal Bladder | 5.3 |
| Melanoma Mets to Lung (OD04321) | 0.0 | Bladder Cancer 1023 | 13.0 |
| Lung Margin (OD04321) | 12.2 | Bladder Cancer A302173 | 6.8 |
| Normal Kidney | 18.4 | Bladder Cancer (OD04718-01) | 2.1 |
| Kidney Ca, Nuclear grade 2 (OD04338) | 11.3 | Bladder Normal Adjacent (OD04718-03) | 24.5 |
| Kidney Margin (OD04338) | 13.7 | Normal Ovary | 12.4 |
| Kidney Ca Nuclear grade 1/2 (OD04339) | 1.6 | Ovarian Cancer 064008 | 100.0 |
| Kidney Margin (OD04339) | 8.0 | Ovarian Cancer (OD04768-07) | 96.6 |
| Kidney Ca, Clear cell type (OD04340) | 5.5 | Ovary Margin (OD04768-08) | 11.5 |
| Kidney Margin (OD04340) | 8.5 | Normal Stomach | 10.2 |
| Kidney Ca, Nuclear grade 3 (OD04348) | 1.0 | Gastric Cancer 9060358 | 3.4 |
| Kidney Margin (OD04348) | 4.6 | Stomach Margin 9060359 | 7.0 |
| Kidney Cancer (OD04622-01) | 3.2 | Gastric Cancer 9060395 | 5.1 |
| Kidney Margin (OD04622-03) | 3.4 | Stomach Margin 9060394 | 6.2 |
| Kidney Cancer (OD04450-01) | 1.4 | Gastric Cancer 9060397 | 3.6 |
| Kidney Margin (OD04450-03) | 8.4 | Stomach Margin 9060396 | 2.5 |
| Kidney Cancer 8120607 | 3.7 | Gastric Cancer 064005 | 7.4 |

CNS_neurodegeneration_v1.0 Summary: Ag2599 This panel confirms expression of the CG55778-01 gene in the central nervous system. Please see Panel 1.3D for discussion of utility of this gene in the central nervous system.

Panel 1.3D Summary: Ag2599 The CG55778-01 gene is most highly expressed (CT values=29–34) in the fetal heart and the testis (CT=29–31)in two runs with the same probe and primer set. This gene product appears to be differentially expressed in fetal (CT values=29–31) vs adult heart (CT values=34–35), and may be useful for the differentiation of the adult from the fetal phenotype in this tissue. Furthermore, the higher levels of expression in fetal heart suggest that this gene product may be involved in the development and homeostasis of this organ. Therapeutic modulation of the expression or function of this gene may be useful in the treatment of diseases that affect the heart, including cardiomyopathy, atherosclerosis, hypertension, and congenital heart defects.

This gene is also expressed in other metabolic tissues, including adult and fetal skeletal muscle and adipose.

Aldose reductase inhibitors prevent peripheral nerve dysfunction and morphological abnormalities in diabetic animal models. Therefore, this gene product may be a small molecule drug target for the prevention of morbidity associated with Types 1 and 2 diabetes in humans.

There also appears to be clusters of expression of this gene in liver adenocarcinoma, melanoma and lung cancer cell lines. This data indicate that the expression of this gene might be associated with these forms of cancer and thus, therapeutic modulation of this gene might be of use in the treatment of these cancer.

Because aldose reductase inhibitors prevent nerve degeneration in the periphery, the cerebral cortex-preferential expression of this gene product in the adult suggests that inhibitors of the protein encoded by this gene may have utility in treating neurodegenerative diseases involving the cerebral cortex, such as Alzheimer's disease, Huntington's disease, depression and possibly even schizophrenia. Furthermore, vascular permeability is a known pathological feature of Alzheimer's disease. Because aldose reductase inhibitors prevent increased vascular permeability associated with disease, inhibitors of this gene product may also have utility in treating Alzheimer's disease by specifically addressing associated vascular pathology in the cerebral cortex.

Panel 2D Summary: Ag2599 The CG55778-01 gene is expressed at a higher level in ovarian and breast cancers compared to normal adjacent tissue (CTs=27–29). There also appears to be higher expression in normal thyroid and kidney tissues compared to the adjacent tumors. Thus, the expression of this gene could be used to distinguish malignant ovary, breast, thyroid and kidney tissue from normal tissue in these organs. In addition, therapeutic modulation of this gene might be of use in the treatment of ovarian and breast cancer.

J. CG55904-01: SQUALENE DESATURASE (NOV8)

Expression of gene CG55904-01 was assessed using the primer-probe set Ag2834, described in Table JA.

Panel 2D Summary: Ag2834 Expression of the CG55904-01 gene is low/undetectable in all samples in this panel (CTs>35).

Panel 3D Summary: Ag2834 Expression of the CG55904-01 gene is low/undetectable in all samples in this panel (CTs>35).

Panel 4D Summary: Ag2834 Expression of the CG55904-01 gene is low/undetectable in all samples in this panel (CTs>35).

TABLE JA

Probe Name Ag2834

| Primers | Sequences | Start Position | SEQ ID NO |
|---|---|---|---|
| Forward | 5'-ggtaggtactgtcggtgaattg-3' | 380 | 302 |
| Probe | TET-5'-cttcatcaaatgaaaataatttcgagcaag-3'-TAMRA | 418 | 303 |
| Reverse | 5'-gcaatcgcagcttcttcag-3' | 448 | 304 |

CNS_neurodegeneration_v1.0 Summary: Ag2834 Expression of the CG55904-01 gene is low/undetectable in all samples in this panel (CTs>35).

Panel 1.3D Summary: Ag2834 Expression of the CG55904-01 gene is low/undetectable in all samples in this panel (CTs>35).

K. CG55920-01 (NOV12a) and CG55920-04 (NOV12b): KILON PROTEIN PRECURSOR

Expression of gene CG55920-01 and variant CG55920-04 was assessed using the primer-probe sets Ag2847 and Ag2880, described in Tables KA and KB. Results of the RTQ-PCR runs are shown in Tables KC, KD, KE, KF and KG.

TABLE KA

Probe Name Ag2847

| Primers | Sequences | Start Position | SEQ ID NO |
|---|---|---|---|
| Forward | 5'-agggactacagcctccagatac-3' | 388 | 305 |
| Probe | TET-5'-atgcccatacacgtgttctgttcag-3'-TAMRA | 431 | 306 |
| Reverse | 5'-cattgttctgggtgtatgttga-3' | 459 | 307 |

TABLE KB

Probe Name Ag2880

| Primers | Sequences | Start Position | SEQ ID NO |
|---|---|---|---|
| Forward | 5'-gctggtaccttgtgttgacact-3' | 1088 | 308 |
| Probe | TET-5'-ccagcatattctacctgaagaatgcca-3'-TAMRA | 1121 | 309 |
| Reverse | 5'-aaagcctttatgggtctttga-3' | 1161 | 310 |

TABLE KC

| | CNS_neurodegeneration_v1.0 | | | | |
|---|---|---|---|---|---|
| Tissue Name | Rel. Exp. (%) Ag2847, Run 208699894 | Rel. Exp. (%) Ag2880, Run 209058910 | Tissue Name | Rel. Exp. (%) Ag2847, Run 208699894 | Rel. Exp. (%) Ag2880, Run 209058910 |
| AD 1 Hippo | 5.6 | 2.4 | Control (Path) 3 Temporal Ctx | 1.9 | 0.3 |
| AD 2 Hippo | 13.9 | 10.5 | Control (Path) 4 Temporal Ctx | 29.3 | 12.8 |
| AD 3 Hippo | 2.7 | 1.1 | AD 1 Occipital Ctx | 11.0 | 4.6 |
| AD 4 Hippo | 3.1 | 0.5 | AD 2 Occipital Ctx (Missing) | 0.0 | 0.0 |
| AD 5 Hippo | 84.1 | 100.0 | AD 3 Occipital Ctx | 1.9 | 1.0 |
| AD 6 Hippo | 19.9 | 19.8 | AD 4 Occipital Ctx | 12.2 | 2.7 |
| Control 2 Hippo | 15.5 | 12.9 | AD 5 Occipital Ctx | 39.0 | 18.9 |
| Control 4 Hippo | 2.1 | 1.4 | AD 6 Occipital Ctx | 24.0 | 46.7 |
| Control (Path) 3 Hippo | 1.3 | 0.4 | Control 1 Occipital Ctx | 0.7 | 0.3 |
| AD 1 Temporal Ctx | 4.6 | 2.0 | Control 2 Occipital Ctx | 50.3 | 66.4 |
| AD 2 Temporal Ctx | 22.8 | 13.9 | Control 3 Occipital Ctx | 12.6 | 3.9 |
| AD 3 Temporal Ctx | 2.1 | 0.7 | Control 4 Occipital Ctx | 1.6 | 1.0 |
| AD 4 Temporal Ctx | 15.0 | 4.0 | Control (Path) 1 Occipital Ctx | 69.3 | 93.3 |
| AD 5 Inf Temporal Ctx | 100.0 | 81.8 | Control (Path) 2 Occipital Ctx | 9.8 | 3.6 |
| AD 5 Sup Temporal Ctx | 20.3 | 16.6 | Control (Path) 3 Occipital Ctx | 0.6 | 0.3 |
| AD 6 Inf Temporal Ctx | 24.3 | 28.7 | Control (Path) 4 Occipital Ctx | 11.2 | 4.7 |
| AD 6 Sup Temporal Ctx | 24.5 | 29.3 | Control 1 Parietal Ctx | 2.5 | 0.6 |
| Control 1 Temporal Ctx | 1.6 | 0.4 | Control 2 Parietal Ctx | 19.3 | 13.3 |
| Control 2 Temporal Ctx | 30.1 | 35.6 | Control 3 Parietal Ctx | 12.6 | 4.9 |
| Control 3 Temporal Ctx | 7.3 | 2.6 | Control (Path) 1 Parietal Ctx | 62.9 | 92.7 |
| Control 3 Temporal Ctx | 2.6 | 1.3 | Control (Path) 2 Parietal Ctx | 15.5 | 9.5 |
| Control (Path) 1 Temporal | 44.1 | 54.7 | Control (Path) 3 Parietal Ctx | 1.2 | 0.3 |

TABLE KC-continued

CNS_neurodegeneration_v1.0

| Tissue Name | Rel. Exp. (%) Ag2847, Run 208699894 | Rel. Exp. (%) Ag2880, Run 209058910 | Tissue Name | Rel. Exp. (%) Ag2847, Run 208699894 | Rel. Exp. (%) Ag2880, Run 209058910 |
|---|---|---|---|---|---|
| Ctx Control (Path) 2 Temporal Ctx | 22.7 | 15.7 | Control (Path) 4 Parietal Ctx | 40.1 | 27.0 |

TABLE KD

Panel 1.3D

| Tissue Name | Rel. Exp. (%) Ag2847, Run 161930455 | Rel. Exp. (%) Ag2880, Run 159996472 | Tissue Name | Rel. Exp. (%) Ag2847, Run 161930455 | Rel. Exp. (%) Ag2880, Run 159996472 |
|---|---|---|---|---|---|
| Liver adenocarcinoma | 1.2 | 0.3 | Kidney (fetal) | 0.9 | 1.3 |
| Pancreas | 0.5 | 0.5 | Renal ca. 786-0 | 0.2 | 0.3 |
| Pancreatic ca. CAPAN 2 | 0.0 | 0.0 | Renal ca. A498 | 0.5 | 0.5 |
| Adrenal gland | 1.1 | 1.8 | Renal ca. RXF 393 | 0.0 | 0.0 |
| Thyroid | 1.4 | 1.4 | Renal ca. ACHN | 0.5 | 0.3 |
| Salivary gland | 0.3 | 0.3 | Renal ca. UO-31 | 4.3 | 4.1 |
| Pituitary gland | 2.6 | 6.0 | Renal ca. TK-10 | 0.0 | 0.1 |
| Brain (fetal) | 4.8 | 8.7 | Liver | 0.0 | 0.1 |
| Brain (whole) | 19.8 | 21.5 | Liver (fetal) | 0.1 | 0.1 |
| Brain (amygdala) | 20.9 | 31.9 | Liver ca. (hepatoblast) HepG2 | 0.0 | 0.0 |
| Brain (cerebellum) | 25.0 | 15.2 | Lung | 2.2 | 4.2 |
| Brain (hippocampus) | 38.4 | 100.0 | Lung (fetal) | 1.2 | 0.4 |
| Brain (substantia nigra) | 3.6 | 4.0 | Lung ca. (small cell) LX-1 | 0.0 | 0.0 |
| Brain (thalamus) | 5.9 | 9.2 | Lung ca. (small cell) NCI-H69 | 0.3 | 0.6 |
| Cerebral Cortex | 100.0 | 40.3 | Lung ca. (s.cell var.) SHP-77 | 1.6 | 1.3 |
| Spinal cord | 11.1 | 2.7 | Lung ca. (large cell) NCI-H460 | 0.2 | 0.1 |
| glio/astro U87-MG | 1.3 | 0.3 | Lung ca. (non-sm. cell) A549 | 0.0 | 0.0 |
| glio/astro U-118-MG | 9.7 | 20.7 | Lung ca. (non-s.cell) NCI-H23 | 0.1 | 0.0 |
| astrocytoma SW1783 | 2.9 | 1.5 | Lung ca. (non-s.cell) HOP-62 | 2.0 | 1.3 |
| neuro*; met SK-N-AS | 0.5 | 2.4 | Lung ca. (non-s.cl) NCI-H522 | 0.1 | 0.0 |
| astrocytoma SF-539 | 0.8 | 0.4 | Lung ca. (squam.) SW 900 | 0.0 | 0.0 |
| astrocytoma SNB-75 | 0.2 | 0.1 | Lung ca. (squam.) NCI-H596 | 0.3 | 0.2 |
| glioma SNB-19 | 0.2 | 0.2 | Mammary gland | 1.4 | 3.8 |
| glioma U251 | 0.8 | 0.4 | Breast ca.* (pl.ef) MCF-7 | 0.0 | 0.0 |
| glioma SF-295 | 0.0 | 0.0 | Breast ca.* (pl.ef) MDA-MB-231 | 0.7 | 3.8 |

TABLE KD-continued

Panel 1.3D

| Tissue Name | Rel. Exp. (%) Ag2847, Run 161930455 | Rel. Exp. (%) Ag2880, Run 159996472 | Tissue Name | Rel. Exp. (%) Ag2847, Run 161930455 | Rel. Exp. (%) Ag2880, Run 159996472 |
|---|---|---|---|---|---|
| Heart (fetal) | 5.4 | 1.0 | Breast ca.* (pl.ef) T47D | 0.0 | 0.0 |
| Heart | 4.7 | 1.9 | Breast ca. BT-549 | 0.2 | 2.0 |
| Skeletal muscle (fetal) | 22.7 | 6.8 | Breast ca. MDA-N | 0.0 | 0.0 |
| Skeletal muscle | 3.8 | 0.6 | Ovary | 5.2 | 1.4 |
| Bone marrow | 0.3 | 0.6 | Ovarian ca. OVCAR-3 | 0.9 | 1.0 |
| Thymus | 8.2 | 1.3 | Ovarian ca. OVCAR-4 | 0.0 | 0.0 |
| Spleen | 0.1 | 0.1 | Ovarian ca. OVCAR-5 | 0.0 | 0.0 |
| Lymph node | 0.7 | 0.6 | Ovarian ca. OVCAR-8 | 1.3 | 1.1 |
| Colorectal | 9.0 | 1.7 | Ovarian ca. IGROV-1 | 0.0 | 0.0 |
| Stomach | 2.2 | 4.0 | Ovarian ca.* (ascites) SK-OV-3 | 0.0 | 0.3 |
| Small intestine | 5.6 | 7.1 | Uterus | 2.2 | 2.5 |
| Colon ca. SW480 | 0.0 | 0.0 | Placenta | 0.5 | 0.6 |
| Colon ca.* SW620 (SW480 met) | 0.0 | 0.0 | Prostate | 0.7 | 0.3 |
| Colon ca. HT29 | 0.0 | 0.0 | Prostate ca.* (bone met) PC-3 | 1.4 | 1.7 |
| Colon ca. HCT-116 | 0.0 | 0.0 | Testis | 1.7 | 1.2 |
| Colon ca. CaCo-2 | 0.0 | 0.0 | Melanoma Hs688(A).T | 5.4 | 2.4 |
| Colon ca. tissue(ODO3866) | 2.5 | 0.9 | Melanoma* (met) Hs688(B).T | 5.5 | 2.3 |
| Colon ca. HCC-2998 | 0.0 | 0.0 | Melanoma UACC-62 | 0.0 | 0.0 |
| Gastric ca.* (liver met) NCI-N87 | 0.0 | 0.4 | Melanoma M14 | 0.0 | 0.4 |
| Bladder | 3.3 | 0.3 | Melanoma LOX IMVI | 0.0 | 0.1 |
| Trachea | 3.9 | 4.0 | Melanoma* (met) SK-MEL-5 | 0.1 | 0.0 |
| Kidney | 2.3 | 0.4 | Adipose | 8.6 | 3.2 |

TABLE KE

Panel 2D

| Tissue Name | Rel. Exp. (%) Ag2847, Run 161930456 | Rel. Exp. (%) Ag2880, Run 159996526 | Tissue Name | Rel. Exp. (%) Ag2847, Run 161930456 | Rel. Exp. (%) Ag2880, Run 159996526 |
|---|---|---|---|---|---|
| Normal Colon | 100.0 | 100.0 | Kidney Margin 8120608 | 7.2 | 2.3 |
| CC Well to Mod Diff (ODO3866) | 2.4 | 4.2 | Kidney Cancer 8120613 | 0.0 | 0.0 |
| CC Margin (ODO3866) | 19.1 | 26.6 | Kidney Margin 8120614 | 10.7 | 3.0 |
| CC Gr.2 rectosigmoid (ODO3868) | 2.7 | 3.4 | Kidney Cancer 9010320 | 1.3 | 0.7 |
| CC Margin (ODO3868) | 15.4 | 17.2 | Kidney Margin 9010321 | 9.6 | 5.1 |
| CC Mod Diff (ODO3920) | 1.6 | 0.7 | Normal Uterus | 17.9 | 12.9 |
| CC Margin | 29.5 | 23.0 | Uterus Cancer | 43.2 | 22.7 |

TABLE KE-continued

Panel 2D

| Tissue Name | Rel. Exp. (%) Ag2847, Run 161930456 | Rel. Exp. (%) Ag2880, Run 159996526 | Tissue Name | Rel. Exp. (%) Ag2847, Run 161930456 | Rel. Exp. (%) Ag2880, Run 159996526 |
|---|---|---|---|---|---|
| (ODO3920) | | | 064011 | | |
| CC Gr.2 ascend colon (ODO3921) | 17.6 | 17.9 | Normal Thyroid | 7.4 | 12.6 |
| CC Margin (ODO3921) | 18.2 | 22.4 | Thyroid Cancer 064010 | 2.0 | 1.0 |
| CC from Partial Hepatectomy (ODO4309) Mets | 0.3 | 1.0 | Thyroid Cancer A302152 | 1.2 | 1.8 |
| Liver Margin (ODO4309) | 0.1 | 1.1 | Thyroid Margin A302153 | 16.0 | 17.6 |
| Colon mets to lung (OD04451-01) | 2.0 | 0.8 | Normal Breast | 16.7 | 13.2 |
| Lung Margin (OD04451-02) | 3.8 | 4.3 | Breast Cancer (OD04566) | 22.5 | 11.2 |
| Normal Prostate 6546-1 | 1.8 | 3.9 | Breast Cancer (OD04590-01) | 9.2 | 8.9 |
| Prostate Cancer (OD04410) | 14.3 | 19.3 | Breast Cancer Mets (OD04590-03) | 26.4 | 20.6 |
| Prostate Margin (OD04410) | 19.9 | 16.7 | Breast Cancer Metastasis (OD04655-05) | 2.9 | 4.6 |
| Prostate Cancer (OD04720-01) | 17.2 | 17.4 | Breast Cancer 064006 | 5.3 | 8.4 |
| Prostate Margin (OD04720-02) | 22.2 | 29.1 | Breast Cancer 1024 | 8.5 | 6.7 |
| Normal Lung 061010 | 35.4 | 43.2 | Breast Cancer 9100266 | 7.9 | 8.7 |
| Lung Met to Muscle (ODO4286) | 14.2 | 13.0 | Breast Margin 9100265 | 7.9 | 5.6 |
| Muscle Margin (ODO4286) | 17.9 | 12.8 | Breast Cancer A209073 | 10.9 | 13.7 |
| Lung Malignant Cancer (OD03126) | 6.6 | 7.5 | Breast Margin A2090734 | 2.5 | 4.1 |
| Lung Margin (OD03126) | 10.3 | 10.2 | Normal Liver | 0.7 | 0.7 |
| Lung Cancer (OD04404) | 2.6 | 3.4 | Liver Cancer 064003 | 0.1 | 0.2 |
| Lung Margin (OD04404) | 12.9 | 12.2 | Liver Cancer 1025 | 0.3 | 0.1 |
| Lung Cancer (OD04565) | 0.9 | 2.0 | Liver Cancer 1026 | 0.2 | 0.1 |
| Lung Margin (OD04565) | 4.0 | 2.1 | Liver Cancer 6004-T | 0.1 | 0.1 |
| Lung Cancer (OD04237-01) | 2.7 | 3.7 | Liver Tissue 6004-N | 0.2 | 0.3 |
| Lung Margin (OD04237-02) | 17.6 | 16.8 | Liver Cancer 6005-T | 0.5 | 0.2 |
| Ocular Mel Met to Liver (ODO4310) | 0.1 | 0.3 | Liver Tissue 6005-N | 0.1 | 0.0 |
| Liver Margin (OD04310) | 0.2 | 0.0 | Normal Bladder | 10.1 | 17.1 |
| Melanoma Mets to Lung (OD04321) | 7.8 | 7.2 | Bladder Cancer 1023 | 1.8 | 1.3 |
| Lung Margin (OD04321) | 31.0 | 23.5 | Bladder Cancer A302173 | 3.9 | 5.4 |
| Normal Kidney | 41.8 | 58.2 | Bladder Cancer (OD04718-01) | 4.4 | 2.2 |
| Kidney Ca, Nuclear grade 2 (OD04338) | 3.4 | 7.9 | Bladder Normal Adjacent (OD04718-03) | 97.9 | 88.3 |

TABLE KE-continued

Panel 2D

| Tissue Name | Rel. Exp. (%) Ag2847, Run 161930456 | Rel. Exp. (%) Ag2880, Run 159996526 | Tissue Name | Rel. Exp. (%) Ag2847, Run 161930456 | Rel. Exp. (%) Ag2880, Run 159996526 |
|---|---|---|---|---|---|
| Kidney Margin (OD04338) | 22.4 | 14.3 | Normal Ovary | 7.2 | 4.0 |
| Kidney Ca Nuclear grade 1/2 (OD04339) | 0.7 | 3.5 | Ovarian Cancer 064008 | 14.0 | 14.8 |
| Kidney Margin (OD04339) | 17.3 | 15.3 | Ovarian Cancer (OD04768-07) | 0.1 | 0.4 |
| Kidney Ca, Clear cell type (OD04340) | 1.3 | 4.0 | Ovary Margin (OD04768-08) | 6.4 | 7.6 |
| Kidney Margin (OD04340) | 35.4 | 40.1 | Normal Stomach | 40.6 | 46.3 |
| Kidney Ca, Nuclear grade 3 (OD04348) | 0.6 | 0.2 | Gastric Cancer 9060358 | 10.8 | 9.0 |
| Kidney Margin (OD04348) | 10.0 | 11.2 | Stomach Margin 9060359 | 9.8 | 11.3 |
| Kidney Cancer (OD04622-01) | 2.0 | 0.9 | Gastric Cancer 9060395 | 26.6 | 36.1 |
| Kidney Margin (OD04622-03) | 2.4 | 3.1 | Stomach Margin 9060394 | 14.2 | 14.7 |
| Kidney Cancer (OD04450-01) | 0.0 | 2.1 | Gastric Cancer 9060397 | 7.5 | 7.9 |
| Kidney Margin (OD04450-03) | 19.8 | 13.0 | Stomach Margin 9060396 | 5.1 | 3.8 |
| Kidney Cancer 8120607 | 2.0 | 1.5 | Gastric Cancer 064005 | 21.0 | 22.4 |

TABLE KF

Panel 4D

| Tissue Name | Rel. Exp. (%) Ag2880, Run 159996551 | Tissue Name | Rel. Exp. (%) Ag2880, Run 159996551 | Tissue Name | Rel. Exp. (%) Ag2880, Run 159996551 | Tissue Name | Rel. Exp. (%) Ag2880, Run 159996551 |
|---|---|---|---|---|---|---|---|
| Secondary Th1 act | 0.2 | HUVEC IL-1beta | 16.0 | CD8 lymphocyte act | 0.2 | Astrocytes rest | 5.7 |
| Secondary Th2 act | 0.0 | HUVEC IFN gamma | 17.8 | Secondary CD8 lymphocyte rest | 0.5 | Astrocytes TNFalpha + IL-1beta | 5.8 |
| Secondary Tr1 act | 0.0 | HUVEC TNF alpha + IFN gamma | 13.9 | Secondary CD8 lymphocyte act | 0.0 | KU-812 (Basophil) rest | 0.7 |
| Secondary Th1 rest | 0.0 | HUVEC TNF alpha + IL4 | 15.8 | CD4 lymphocyte none | 0.0 | KU-812 (Basophil) PMA/ionomycin | 0.5 |
| Secondary Th2 rest | 0.0 | HUVEC IL-11 | 5.3 | 2ry Th1/Th2/Tr1_anti-CD95 CH11 | 0.0 | CCD1106 (Keratinocytes) none | 0.0 |
| Secondary Tr1 rest | 0.0 | Lung Microvascular EC none | 6.6 | | | | |
| Primary Th1 act | 0.0 | Lung Microvascular EC TNFalpha + IL-1beta | 12.1 | LAK cells rest | 0.0 | CCD1106 (Keratinocytes) TNFalpha + IL-1beta | 0.0 |
| Primary Th2 act | 0.6 | Microvascular Dermal EC none | 4.6 | LAK cells IL-2 | 0.3 | Liver cirrhosis | 1.3 |
| Primary Tr1 act | 1.2 | Microvasular Dermal EC TNFalpha + IL-1beta | 1.3 | LAK cells IL-2 + IL-12 | 0.2 | Lupus kidney | 3.5 |
| Primary Th1 rest | 0.6 | Bronchial epithelium TNFalpha + IL1beta | 2.7 | LAK cells IL-2 + IFN gamma | 0.2 | NCI-H292 none | 2.4 |
| Primary Th2 rest | 0.4 | Small airway epithelium none | 0.7 | | | | |
| Primary Tr1 rest | 0.0 | Small airway epithelium TNFalpha + IL-1beta | 1.6 | LAK cells IL-2 + IL-18 | 0.2 | NCI-H292 IL-4 | 7.5 |
| CD45RA CD4 lymphocyte act | 21.5 | Coronery artery SMC rest | 53.2 | | | | |
| CD45RO CD4 lymphocyte act | 0.7 | Coronery artery SMC TNFalpha + IL-1beta | 27.5 | | | | |

TABLE KF-continued

Panel 4D

| Tissue Name | Rel. Exp. (%) Ag2880, Run 159996551 | Tissue Name | Rel. Exp. (%) Ag2880, Run 159996551 |
|---|---|---|---|
| LAK cells PMA/ionomycin | 0.0 | NCI-H292 IL-9 | 9.3 |
| NK Cells IL-2 rest | 0.0 | NCI-H292 IL-13 | 3.5 |
| Two Way MLR 3 day | 0.7 | NCI-H292 IFN gamma | 2.4 |
| Two Way MLR 5 day | 0.4 | HPAEC none | 16.5 |
| Two Way MLR 7 day | 0.1 | HPAEC TNF alpha + IL-1 beta | 17.4 |
| PBMC rest | 0.0 | Lung fibroblast none | 7.3 |
| PBMC PWM | 0.1 | Lung fibroblast TNF alpha + IL-1 beta | 3.2 |
| PBMC PHA-L | 0.0 | Lung fibroblast IL-4 | 14.6 |
| Ramos (B cell) none | 7.0 | Lung fibroblast IL-9 | 15.3 |
| Ramos (B cell) ionomycin | 100.0 | Lung fibroblast IL-13 | 8.4 |
| B lymphocytes PWM | 0.4 | Lung fibroblast IFN gamma | 15.2 |
| B lymphocytes CD40L and IL-4 | 0.8 | Dermal fibroblast CCD1070 rest | 89.5 |
| EOL-1 dbcAMP | 0.0 | Dermal fibroblast CCD1070 TNF alpha | 88.3 |
| EOL-1 dbcAMP PMA/ionomycin | 0.2 | Dermal fibroblast CCD1070 IL-1 beta | 51.4 |
| Dendritic cells none | 0.0 | Dermal fibroblast IFN gamma | 20.7 |
| Dendritic cells LPS | 0.1 | Dermal fibroblast IL-4 | 35.6 |
| Dendritic cells anti-CD40 | 0.6 | IBD Colitis 2 | 5.0 |
| Monocytes rest | 1.7 | IBD Crohn's | 6.1 |
| Monocytes LPS | 0.0 | Colon | 42.0 |
| Macrophages rest | 0.0 | Lung | 16.5 |
| Macrophages LPS | 0.0 | Thymus | 44.4 |
| HUVEC none | 33.7 | Kidney | 19.2 |
| HUVEC starved | 70.7 | | |

TABLE KG

Panel CNS_1

| Tissue Name | Rel. Exp. (%) Ag2847, Run 171669934 | Rel. Exp. (%) Ag2880, Run 171688447 | Tissue Name | Rel. Exp. (%) Ag2847, Run 171669934 | Rel. Exp. (%) Ag2880, Run 171688447 |
|---|---|---|---|---|---|
| BA4 Control | 31.2 | 13.0 | BA17 PSP | 34.2 | 8.7 |
| BA4 Control2 | 61.6 | 58.6 | BA17 PSP2 | 9.6 | 2.6 |
| BA4 Alzheimer's2 | 6.1 | 0.7 | Sub Nigra Control | 12.2 | 5.3 |
| BA4 Parkinson's | 36.6 | 15.9 | Sub Nigra Control2 | 19.6 | 19.6 |
| BA4 Parkinson's2 | 68.8 | 60.3 | Sub Nigra Alzheimer's2 | 5.9 | 1.2 |
| BA4 Huntington's | 31.6 | 30.1 | Sub Nigra Parkinson's2 | 24.0 | 17.7 |
| BA4 Huntington's2 | 4.6 | 0.0 | Sub Nigra Huntington's | 31.9 | 14.6 |
| BA4 PSP | 7.7 | 1.1 | Sub Nigra Huntington's2 | 11.2 | 7.3 |
| BA4 PSP2 | 27.7 | 9.7 | Sub Nigra PSP2 | 6.0 | 2.5 |
| BA4 Depression | 14.5 | 6.3 | Sub Nigra Depression | 2.5 | 3.2 |
| BA4 Depression2 | 8.3 | 0.0 | Sub Nigra Depression2 | 3.7 | 1.2 |
| BA7 Control | 53.2 | 23.3 | Glob Palladus Control | 5.1 | 2.6 |

TABLE KG-continued

Panel CNS_1

| Tissue Name | Rel. Exp. (%) Ag2847, Run 171669934 | Rel. Exp. (%) Ag2880, Run 171688447 | Tissue Name | Rel. Exp. (%) Ag2847, Run 171669934 | Rel. Exp. (%) Ag2880, Run 171688447 |
|---|---|---|---|---|---|
| BA7 Control2 | 33.7 | 25.3 | Glob Palladus Control2 | 6.1 | 2.5 |
| BA7 Alzheimer's2 | 11.6 | 2.3 | Glob Palladus Alzheimer's | 4.5 | 2.1 |
| BA7 Parkinson's | 16.6 | 5.3 | Glob Palladus Alzheimer's2 | 1.7 | 1.1 |
| BA7 Parkinson's2 | 51.4 | 45.1 | Glob Palladus Parkinson's | 36.6 | 25.5 |
| BA7 Huntington's | 42.3 | 22.8 | Glob Palladus Parkinson's2 | 5.3 | 1.2 |
| BA7 Huntington's2 | 50.7 | 14.0 | Glob Palladus PSP | 1.7 | 0.6 |
| BA7 PSP | 43.8 | 21.8 | Glob Palladus PSP2 | 3.9 | 0.0 |
| BA7 PSP2 | 36.3 | 19.5 | Glob Palladus Depression | 2.0 | 0.4 |
| BA7 Depression | 12.7 | 1.2 | Temp Pole Control | 17.1 | 9.3 |
| BA9 Control | 25.0 | 9.7 | Temp Pole Control2 | 69.7 | 57.8 |
| BA9 Control2 | 100.0 | 100.0 | Temp Pole Alzheimer's | 7.9 | 0.3 |
| BA9 Alzheimer's | 8.1 | 1.1 | Temp Pole Alzheimer's2 | 5.3 | 1.3 |
| BA9 Alzheimer's2 | 18.3 | 3.5 | Temp Pole Parkinson's | 30.6 | 13.6 |
| BA9 Parkinson's | 37.1 | 13.5 | Temp Pole Parkinson's2 | 29.3 | 11.3 |
| BA9 Parkinson's2 | 63.3 | 55.1 | Temp Pole Huntington's | 43.2 | 18.3 |
| BA9 Huntington's | 55.1 | 32.3 | Temp Pole PSP | 7.0 | 0.5 |
| BA9 Huntington's2 | 12.2 | 0.9 | Temp Pole PSP2 | 8.6 | 0.5 |
| BA9 PSP | 15.2 | 4.3 | Temp Pole Depression2 | 4.5 | 0.7 |
| BA9 PSP2 | 7.2 | 2.5 | Cing Gyr Control | 73.2 | 40.6 |
| BA9 Depression | 3.5 | 3.1 | Cing Gyr Control2 | 38.2 | 17.4 |
| BA9 Depression2 | 7.9 | 1.6 | Cing Gyr Alzheimer's | 25.5 | 8.8 |
| BA17 Control | 59.0 | 19.6 | Cing Gyr Alzheimer's2 | 9.5 | 1.4 |
| BA17 Control2 | 67.8 | 39.5 | Cing Gyr Parkinson's | 24.3 | 9.3 |
| BA17 Alzheimer's2 | 16.8 | 1.8 | Cing Gyr Parkinson's2 | 34.4 | 32.8 |
| BA17 Parkinson's | 37.4 | 9.1 | Cing Gyr Huntington's | 63.7 | 38.4 |
| BA17 Parkinson's2 | 56.6 | 36.6 | Cing Gyr Huntington's2 | 12.5 | 4.6 |
| BA17 Huntington's | 37.1 | 16.3 | Cing Gyr PSP | 15.5 | 7.5 |
| BA17 Huntington's2 | 15.9 | 5.1 | Cing Gyr PSP2 | 5.8 | 0.0 |
| BA17 Depression | 6.1 | 0.0 | Cing Gyr Depression | 2.9 | 0.0 |
| BA17 Depression2 | 28.1 | 7.1 | Cing Gyr Depression2 | 9.2 | 1.8 |

CNS_neurodegeneration_v1.0 Summary: Ag2847/2880 No clear relationship between the expression levels of the CG55920-01 gene and Alzheimer's disease is evident in panel CNS_neurodegeneration_v1.0. See Panel 1.3D for discussion of utility of this gene in the central nervous system.

Panel 1.3D Summary: Ag2847/2880 Two experiments with two different probe and primer sets show highest expression of the CG55920-01 gene, a kilon homolog, in the brain. This expression profile is consistant with published reports of kilon expression. The sequence of kilon shows a high degree of homology to that of the chicken protein neurotractin, a molecule involved in neurite outgrowth capable of interacting with LAMP.

Because this class of molecule is thought to play a role in the guidance of growing axons, and kilon is expressed specifically in neurons, it has been suggested that they confer the ability to rearrange dendritic connectivity on magnocellular neurons. Degeneration of dendritic orphology and connectivity is a pathological characteristic of neurodegenerative diseases, such as Alzheimer's disease. Recombinant neurotractin promotes neurite outgrowth of telencephalic neurons and interacts with the IgSF members CEPU-1. Therefore, this gene product may be used as a protein therapeutic to counter neurodegeneration in a range of neurodegenerative diseases.

In addition to the brain preferential expression on this panel, expression is relatively absent in brain cancer derived cell lines. Thus, the expression of this gene could be used to distinguish brain-derived tissue from other tissues in the panel. Moreover, therapeutic modulation of this gene, through the use of small molecule drugs, antibodies or protein therapeutics might be of use in the treatment of brain cancer.

This gene is also moderately expressed in a variety of metabolic tissues including pancreas, adrenal, thyroid, pituitary, adult and fetal heart, and adipose. Thus, this gene may be an antibody target for the treatment of disease in these tissues, including Types 1 and 2 diabetes, and obesity.

Panel 2D Summary: Ag2847/2880 Two experiments with different probe and primer sets produce results that are in very good agreement, with highest expression of the CG55920-01 gene in a sample derived from normal colon tissue (CTs=27–29). In addition, there is substantial expression of this gene in samples derived from normal colon tissue when compared to their adjacent malignant counterparts. The trend toward differential expression in normal tissues over their malignant counterparts is also seen in kidney samples and bladder samples. Thus, the expression of this gene could be used to distinguish normal colon, bladder or kidney from their malignant counterparts. Moreover, therapeutic modulation of this gene, through the use of small molecule drugs, antibodies or protein therapeutics might be of use in the treatment of colon, bladder or kidney cancer.

Panel 4D Summary: Ag2880 The CG55920-01 transcript is expressed in endothelial cells, fibroblasts, activated Ramos B cells and activated CD45RA (naive) T cells but not in primary B cells. This transcript encodes a putative adhesion molecule that has been hypothesized to be involved in the establishment and remodeling of neural circuits. The role of this protein in the immune system has not been examined, however, based on its CNS function it may be involved in cell—cell binding that leads to leukocyte interactions with endothelium resulting in leukocyte extravasation. Alternatively, the protein encoded for by this transcript may be important in other cellular interactions. Therapeutics designed with the protein encoded for by this transcript could be important in the treatment of inflammation resulting from asthma, chronic obstructive pulmonary disease, inflammatory bowel disease, arthritis, and psoriasis. Please note that data from a second experiment using the probe and primer set Ag2847 is not included because the amp plot suggests that there were experimental difficulties with this run.

Panel CNS_1 Summary: Ag2847/2880 Two experiments with different probe and primer sets produce results that are in very good agreement, confirming expression of the CG55920-01 gene in the brain. See Panel 1.3D for discussion of utility of this gene in the central nervous system.

L. CG55988-01: ORGANIC CATION TRANSPORTER (NOV13a)

Expression of gene CG55988-01 was assessed using the primer-probe set Ag2861, described in Table LA. Results of the RTQ-PCR runs are shown in Tables LB, LC and LD.

TABLE LA

Probe Name Ag2861

| Primers | Sequences | Start Position | SEQ ID NO |
|---|---|---|---|
| Forward | 5'-tctcttgcagattccagagagt-3' | 193 | 311 |
| Probe | TET-5'-tgtgccttccagaacatctcttgtgg-3'-TAMRA | 228 | 312 |
| Reverse | 5'-tgaacacagaagccaagtagtg-3' | 258 | 313 |

TABLE LB

Panel 1.3D

| Tissue Name | Rel. Exp. (%) Ag2861, Run 161974432 | Rel. Exp. (%) Ag2861, Run 165721638 | Tissue Name | Rel. Exp. (%) Ag2861, Run 161974432 | Rel. Exp. (%) Ag2861, Run 165721638 |
|---|---|---|---|---|---|
| Liver adenocarcinoma | 0.0 | 0.0 | Kidney (fetal) | 4.1 | 2.2 |
| Pancreas | 0.0 | 0.0 | Renal ca. 786-0 | 0.0 | 0.0 |
| Pancreatic ca. CAPAN2 | 0.0 | 0.0 | Renal ca. A498 | 0.0 | 0.0 |
| Adrenal gland | 0.0 | 0.0 | Renal ca. RXF 393 | 0.0 | 0.0 |
| Thyroid | 0.0 | 0.0 | Renal ca. ACHN | 0.0 | 0.0 |
| Salivary gland | 0.0 | 0.0 | Renal ca. UO-31 | 0.0 | 0.0 |
| Pituitary gland | 0.0 | 0.0 | Renal ca. TK-10 | 0.0 | 0.0 |
| Brain (fetal) | 0.0 | 1.5 | Liver | 0.0 | 0.0 |
| Brain (whole) | 0.0 | 0.0 | Liver (fetal) | 32.3 | 35.8 |
| Brain (amygdala) | 0.0 | 0.0 | Liver ca. (hepatoblast) HepG2 | 1.5 | 1.6 |
| Brain (cerebellum) | 0.0 | 0.0 | Lung | 0.0 | 0.0 |
| Brain (hippocampus) | 0.0 | 1.5 | Lung (fetal) | 0.0 | 0.0 |
| Brain (substantia nigra) | 0.0 | 0.0 | Lung ca. (small cell) LX-1 | 0.0 | 0.0 |
| Brain (thalamus) | 0.0 | 0.0 | Lung ca. (small cell) NCI-H69 | 0.0 | 0.0 |
| Cerebral Cortex | 0.5 | 0.0 | Lung ca. (s.cell var.) SHP-77 | 0.0 | 0.0 |
| Spinal cord | 0.0 | 0.0 | Lung ca. (large cell) NCI-H460 | 0.0 | 0.0 |
| glio/astro U87-MG | 0.0 | 0.0 | Lung ca. (non-sm. cell) A549 | 0.0 | 0.0 |
| glio/astro U-118-MG | 0.0 | 0.0 | Lung ca. (non-s.cell) NCI-H23 | 0.0 | 1.9 |
| astrocytoma SW1783 | 0.0 | 0.0 | Lung ca. (non-s.cell) HOP-62 | 0.0 | 0.0 |
| neuro*; met SK-N-AS | 0.0 | 0.0 | Lung ca. (non-s.cl) NCI-H522 | 0.0 | 0.0 |
| astrocytoma SF-539 | 0.0 | 0.0 | Lung ca. (squam.) SW 900 | 0.0 | 0.0 |
| astrocytoma SNB-75 | 0.0 | 0.0 | Lung ca. (squam.) NCI-H596 | 1.7 | 2.0 |
| glioma SNB-19 | 0.0 | 0.0 | Mammary gland | 12.8 | 1.6 |
| glioma U251 | 1.1 | 0.0 | Breast ca.* (pl.ef) MCF-7 | 0.0 | 0.0 |
| glioma SF-295 | 0.0 | 0.0 | Breast ca.* (pl.ef) MDA-MB-231 | 0.0 | 0.0 |
| Heart (fetal) | 6.9 | 0.0 | Breast ca.* (pl.ef) T47D | 0.0 | 0.0 |
| Heart | 0.0 | 0.0 | Breast ca. BT-549 | 0.0 | 1.0 |
| Skeletal muscle (fetal) | 11.4 | 0.0 | Breast ca. MDA-N | 0.0 | 0.0 |
| Skeletal muscle | 0.0 | 0.0 | Ovary | 2.0 | 0.0 |
| Bone marrow | 100.0 | 100.0 | Ovarian ca. OVCAR-3 | 0.0 | 0.0 |
| Thymus | 6.3 | 0.7 | Ovarian ca. OVCAR-4 | 0.0 | 0.0 |
| Spleen | 0.0 | 0.0 | Ovarian ca. OVCAR-5 | 0.0 | 0.0 |
| Lymph node | 1.4 | 0.0 | Ovarian ca. OVCAR-8 | 0.0 | 0.0 |
| Colorectal | 0.0 | 1.4 | Ovarian ca. IGROV-1 | 0.0 | 0.0 |
| Stomach | 0.0 | 0.0 | Ovarian ca.* | 0.0 | 3.2 |

TABLE LB-continued

Panel 1.3D

| Tissue Name | Rel. Exp. (%) Ag2861, Run 161974432 | Rel. Exp. (%) Ag2861, Run 165721638 | Tissue Name | Rel. Exp. (%) Ag2861, Run 161974432 | Rel. Exp. (%) Ag2861, Run 165721638 |
|---|---|---|---|---|---|
| Small intestine | 0.0 | 0.0 | (ascites)SK-OV-3 Uterus | 6.7 | 7.9 |
| Colon ca. SW480 | 0.0 | 0.0 | Placenta | 0.9 | 1.5 |
| Colon ca.* SW620 (SW480 met) | 0.0 | 0.0 | Prostate | 0.0 | 0.0 |
| Colon ca. HT29 | 0.0 | 1.4 | Prostate ca.* (bone met) PC-3 | 0.0 | 0.0 |
| Colon ca. HCT-116 | 0.0 | 0.0 | Testis | 33.4 | 12.5 |
| Colon ca. CaCo-2 | 0.0 | 0.0 | Melanoma Hs688(A).T | 0.0 | 0.0 |
| Colon ca. tissue(ODO3866) | 2.8 | 0.0 | Melanoma* (met) Hs688(B).T | 0.0 | 0.0 |
| Colon ca. HCC-2998 | 0.0 | 0.0 | Melanoma UACC-62 | 0.0 | 0.0 |
| Gastric ca.* (liver met) NCI-N87 | 0.0 | 0.0 | Melanoma M14 | 0.0 | 0.5 |
| Bladder | 4.0 | 0.0 | Melanoma LOX IMVI | 0.0 | 0.0 |
| Trachea | 11.2 | 0.0 | Melanoma* (met) SK-MEL-5 | 0.0 | 0.0 |
| Kidney | 0.0 | 0.0 | Adipose | 1.5 | 0.4 |

TABLE LC

Panel 2D

| Tissue Name | Rel. Exp. (%) Ag2861, Run 161974611 | Tissue Name | Rel. Exp. (%) Ag2861, Run 161974611 | Tissue Name | Rel. Exp. (%) Ag2861, Run 161974611 | Tissue Name | Rel. Exp. (%) Ag2861, Run 161974611 |
|---|---|---|---|---|---|---|---|
| Normal Colon | 0.6 | Kidney Margin 8120608 | 0.0 | (OD04410) | | Metastasis (OD04655-05) | |
| CC Well to Mod Diff (ODO3866) | 0.5 | Kidney Cancer 8120613 | 0.0 | Prostate Cancer (OD04720-01) | 0.2 | Breast Cancer 064006 | 0.0 |
| CC Margin (ODO3866) | 0.3 | Kidney Margin 8120614 | 0.0 | Prostate Margin (OD04720-02) | 0.0 | Breast Cancer 1024 | 0.9 |
| CC Gr.2 rectosigmoid (ODO3868) | 0.0 | Kidney Cancer 9010320 | 0.6 | Normal Lung 061010 | 0.6 | Breast Cancer 9100266 | 0.0 |
| CC Margin (ODO3868) | 0.0 | Kidney Margin 9010321 | 0.3 | Lung Met to Muscle (ODO4286) | 0.6 | Breast Margin 9100265 | 0.7 |
| CC Mod Diff (ODO3920) | 0.1 | Normal Uterus | 1.0 | Muscle Margin (ODO4286) | 0.5 | Breast Cancer A209073 | 0.4 |
| CC Margin (ODO3920) | 0.0 | Uterus Cancer 064011 | 0.2 | Lung Malignant Cancer (ODO3126) | 0.2 | Breast Margin A2090734 | 0.7 |
| CC Gr.2 ascend colon (ODO3921) | 0.2 | Normal Thyroid | 0.0 | Lung Margin (ODO3126) | 0.5 | Normal Liver | 0.0 |
| CC Margin (ODO3921) | 0.3 | Thyroid Cancer 064010 | 0.2 | Lung Cancer (OD04404) | 0.4 | Liver Cancer 064003 | 0.0 |
| CC from Partial Hepatectomy (ODO4309) Mets | 0.1 | Thyroid Cancer A302152 | 0.0 | Lung Margin (OD04404) | 1.3 | Liver Cancer 1025 | 0.0 |
| | | | | Lung Cancer (OD04565) | 0.2 | Liver Cancer 1026 | 0.0 |
| Liver Margin (ODO4309) | 0.3 | Thyroid Margin A302153 | 0.0 | Lung Margin (OD04565) | 0.8 | Liver Cancer 6004-T | 0.3 |
| Colon mets to lung (OD04451-01) | 0.0 | Normal Breast | 0.0 | Lung Cancer (OD04237-01) | 0.2 | Liver Tissue 6004-N | 0.1 |
| Lung Margin (OD04451-02) | 0.1 | Breast Cancer (OD04566) | 0.0 | Lung Margin (OD04237-02) | 0.7 | Liver Cancer 6005-T | 0.0 |
| Normal Prostate 6546-1 | 0.0 | Breast Cancer (OD04590-01) | 0.0 | Ocular Mel Met to Liver (ODO4310) | 0.0 | Liver Tissue 6005-N | 0.0 |
| Prostate Cancer (OD04410) | 0.7 | Breast Cancer Mets (OD04590-03) | 0.1 | Liver Margin (ODO4310) | 0.0 | Normal Bladder | 0.0 |
| Prostate Margin | 0.0 | Breast Cancer | 0.4 | Melanoma Mets | 0.7 | Bladder Cancer 1023 | 0.2 |

TABLE LC-continued

Panel 2D

| Tissue Name | Rel. Exp. (%) Ag2861, Run 161974611 | Tissue Name | Rel. Exp. (%) Ag2861, Run 161974611 |
|---|---|---|---|
| to Lung (OD04321) Lung Margin | 3.7 | Bladder Cancer A302173 | 1.7 |
| Normal Kidney | 0.5 | Bladder Cancer (OD04718-01) | 0.6 |
| Kidney Ca, Nuclear grade 2 (OD04338) | 1.1 | Bladder Normal Adjacent (OD04718-03) | 0.0 |
| Kidney Margin (OD04338) | 0.9 | Normal Ovary | 0.0 |
| Kidney Ca Nuclear grade 1/2 (OD04339) | 0.0 | Ovarian Cancer 064008 | 0.2 |
| Kidney Margin (OD04339) | 0.0 | Ovarian Cancer (OD04768-07) | 100.0 |
| Kidney Ca, Clear cell type (OD04340) | 0.1 | Ovary Margin (OD04768-08) | 0.0 |
| Kidney Margin (OD04340) | 0.0 | Normal Stomach | 0.0 |
| Kidney Ca, Nuclear grade 3 (OD04348) | 0.7 | Gastric Cancer 9060358 | 0.1 |
| Kidney Margin (OD04348) | 0.0 | Stomach Margin 9060359 | 0.5 |
| Kidney Cancer (OD04622-01) | 1.1 | Gastric Cancer 9060395 | 0.0 |
| Kidney Margin (OD04622-03) | 0.0 | Stomach Margin 9060394 | 0.6 |
| Kidney Cancer (OD04450-01) | 0.0 | Gastric Cancer 9060397 | 0.7 |
| Kidney Margin (OD04450-03) | 0.0 | Stomach Margin 9060396 | 0.0 |
| Kidney Cancer 8120607 | 0.3 | Gastric Cancer 064005 | 0.2 |

TABEL LD

Panel 4D

| Tissue Name | Rel. Exp. (%) Ag2861, Run 159616582 | Tissue Name | Rel. Exp. (%) Ag2861, Run 159616582 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 1.4 |
| Primary Th1 act | 0.0 | Lung Microvascular EC TNFalpha + IL-1beta | 0.0 |
| Primary Th2 act | 0.0 | Microvascular Dermal EC none | 0.0 |
| Primary Tr1 act | 0.0 | Microvsavular Dermal EC TNFalpha + IL-1beta | 0.0 |
| Primary Th1 rest | 0.0 | Bronchial epithelium TNFalpha + IL-1beta | 0.0 |
| Primary Th2 rest | 1.7 | Small airway epithelium none | 0.0 |
| Primary Tr1 rest | 0.0 | Small airway epithelium TNFalpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.6 | Astrocytes TNFalpha + IL-1beta | 0.0 |
| Secondary CD8 lymphocyte act | 0.0 | KU-812 (Basophil) rest | 54.3 |
| CD4 lymphocyte none | 0.0 | KU-812 (Basophil) PMA/ionomycin | 71.2 |
| 2ry Th1/Th2/Tr1_anti-CD95 CH11 | 0.0 | CCD1106 (Keratinocytes) none | 2.6 |
| LAK cells rest | 12.8 | CCD1106 (Keratinocytes) TNFalpha + IL-1beta | 0.0 |
| LAK cells IL-2 | 0.0 | Liver cirrhosis | 4.5 |
| LAK cells IL-2 + IL-12 | 1.1 | Lupus kidney | 0.0 |
| LAK cells IL-2 + IFN gamma | 1.0 | NCI-H292 none | 0.0 |
| LAK cells IL-2 + IL-18 | 0.8 | NCI-H292 IL-4 | 0.0 |
| LAK cells PMA/ionomycin | 0.0 | NCI-H292 IL-9 | 0.0 |
| NK Cells IL-2 rest | 0.0 | NCI-H292 IL-13 | 1.4 |
| Two Way MLR 3 day | 11.0 | NCI-H292 IFN gamma | 0.0 |
| Two Way MLR 5 day | 0.6 | HPAEC none | 0.0 |
| Two Way MLR 7 day | 0.0 | HPAEC TNF alpha + IL-1 beta | 0.0 |
| PBMC rest | 3.8 | Lung fibroblast none | 0.0 |
| PBMC PWM | 0.0 | Lung fibroblast TNF alpha + IL-1 beta | 0.0 |
| PBMC PHA-L | 0.0 | Lung fibroblast IL-4 | 2.5 |
| Ramos (B cell) none | 0.0 | Lung fibroblast IL-9 | 0.0 |
| Ramos (B cell) ionomycin | 0.0 | Lung fibroblast IL-13 | 3.0 |
| B lymphocytes PWM | 0.0 | Lung fibroblast IFN gamma | 0.0 |
| B lymphocytes CD40L and IL-4 | 1.3 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1 beta | 0.0 |
| Dendritic cells none | 25.3 | Dermal fibroblast IFN gamma | 0.0 |
| Dendritic cells LPS | 100.0 | Dermal fibroblast IL-4 | 0.0 |
| Dendritic cells anti-CD40 | 69.7 | IBD Colitis 2 | 0.0 |
| Monocytes rest | 36.1 | IBD Crohn's | 0.0 |
| Monocytes LPS | 7.4 | Colon | 0.0 |
| Macrophages rest | 94.0 | Lung | 2.1 |

TABEL LD-continued

Panel 4D

| Tissue Name | Rel. Exp. (%) Ag2861, Run 159616582 | Tissue Name | Rel. Exp. (%) Ag2861, Run 159616582 |
|---|---|---|---|
| Macrophages LPS | 31.9 | Thymus | 0.0 |
| HUVEC none | 0.0 | Kidney | 34.4 |
| HUVEC starved | 0.0 | | |

Panel 1.3D Summary: Ag2861 The expression of the CG55988-01 gene is highest in bone marrow (CTs=31–32) in two experiments with the same probe and primer. In addition, there was substantial expression in samples derived from testis and fetal liver. This expression profile is consistant with published data (See references below). Thus, the expression of this gene could be used to distinguish these tissues from other tissues in the panel. Furthermore, the higher levels of expression in fetal liver when compared to adult liver suggest that this gene product may be involved in the development and homeostasis of the liver. Thus, therapeutic modulation of the expression or function of the protein encoded by this gene may be effective in the treatment of diseases that affect the liver or the function of this gene product in the liver.

Panel 4D Summary: Ag2861 The CG55988-01 transcript is expressed in KU-812 cells, macrophages and dendritic cells (CTs=31–33). The transcript is more highly expressed in resting macrophages and monocytes than in treated cells of these types, but is induced in anti-CD40 or LPS treated dendritic cells. The protein encoded by this transcript may be important in monocytic differentiation and in dendritic cell differentiation and activation. Therefore, regulating the expression of this transcript or the function of the protein it encodes could alter the types and levels of monocytic cells regulated by cytokine and chemokine production and T cell activation. Therapeutics designed with the protein encoded by this transcript could therefore be important for the treatment of asthma, emphysema, inflammatory bowel disease, arthritis and psoriasis.

M. CG56001-01: 3-HYDROXYBUTYRATE DEHYDROGENASE (NOV14a)

Expression of gene CG56001-01 was assessed using the primer-probe set Ag2868, described in Table MA. Results of the RTQ-PCR runs are shown in Tables MB, MC, MD, ME and MF.

TABLE MA

Probe Name Ag2868

| Primers | Sequences | Start Position | SEQ ID NO |
|---|---|---|---|
| Forward | 5'-ctactactggtggctgcgaat-3' | 1025 | 314 |
| Probe | TET-5'-cagatcatgacccacttgcctggag-3'-TAMRA | 1047 | 315 |
| Reverse | 5'-actcttcagcggatgtagatca-3' | 1084 | 316 |

TABLE MB

CNS neurodegeneration_v1.0

| Tissue Name | Rel. Exp. (%) Ag2868, Run 206485413 | Rel. Exp. (%) Ag2868, Run 224079571 | Tissue Name | Rel. Exp. (%) Ag2868, Run 206485413 | Rel. Exp. (%) Ag2868, Run 224079571 |
|---|---|---|---|---|---|
| AD 1 Hippo | 10.7 | 11.1 | Control (Path) 3 Temporal Ctx | 8.2 | 9.7 |
| AD 2 Hippo | 32.1 | 39.2 | Control (Path) 4 Temporal Ctx | 50.7 | 56.3 |
| AD 3 Hippo | 8.7 | 4.0 | AD 1 Occipital Ctx | 16.0 | 20.6 |
| Ad 4 Hippo | 12.3 | 9.6 | AD 2 Occipital Ctx (Missing) | 0.0 | 0.0 |
| AD 5 Hippo | 99.3 | 74.2 | AD 3 Occipital Ctx | 6.3 | 8.4 |
| AD 6 Hippo | 34.4 | 35.8 | AD 4 Occipital Ctx | 24.8 | 22.7 |
| Control 2 Hippo | 27.9 | 29.3 | AD 5 Occipital Ctx | 48.3 | 19.3 |

TABLE MB-continued

CNS neurodegeneration_v1.0

| Tissue Name | Rel. Exp. (%) Ag2868, Run 206485413 | Rel. Exp. (%) Ag2868, Run 224079571 | Tissue Name | Rel. Exp. (%) Ag2868, Run 206485413 | Rel. Exp. (%) Ag2868, Run 224079571 |
|---|---|---|---|---|---|
| Control 4 Hippo | 15.4 | 13.1 | AD 6 Occipital Ctx | 18.2 | 43.5 |
| Control (Path) 3 Hippo | 8.7 | 12.9 | Control 1 Occipital Ctx | 6.6 | 5.5 |
| AD 1 Temporal Ctx | 12.4 | 9.7 | Control 2 Occipital Ctx | 67.4 | 60.7 |
| AD 2 Temporal Ctx | 34.9 | 40.6 | Control 3 Occipital Ctx | 26.2 | 28.9 |
| AD 3 Temporal Ctx | 6.3 | 5.0 | Control 4 Occipital Ctx | 7.6 | 5.5 |
| AD 4 Temporal Ctx | 13.4 | 28.9 | Control (Path) 1 Occipital Ctx | 92.0 | 68.8 |
| AD 5 Inf Temporal Ctx | 100.0 | 100.0 | Control (Path) 2 Occipital Ctx | 18.9 | 15.6 |
| AD 5 Sup Temporal Ctx | 57.0 | 46.3 | Control (Path) 3 Occipital Ctx | 3.8 | 2.7 |
| AD 6 Inf Temporal Ctx | 32.3 | 33.4 | Control (Path) 4 Occipital Ctx | 35.1 | 30.6 |
| AD 6 Sup Temporal Ctx | 45.4 | 39.0 | Control 1 Parietal Ctx | 15.5 | 10.1 |
| Control 1 Temporal Ctx | 10.0 | 12.6 | Control 2 Parietal Ctx | 47.0 | 36.3 |
| Control 2 Temporal Ctx | 53.6 | 43.2 | Control 3 Parietal Ctx | 17.3 | 29.5 |
| Control 3 Temporal Ctx | 28.1 | 20.7 | Control (Path) 1 Parietal Ctx | 94.6 | 77.9 |
| Control 3 Temporal Ctx | 16.8 | 15.6 | Control (Path) 2 Parietal Ctx | 35.4 | 41.2 |
| Control (Path) 1 Temporal Ctx | 73.2 | 63.3 | Control (Path) 3 Parietal Ctx | 4.3 | 6.2 |
| Control (Path) 2 Temporal Ctx | 57.8 | 43.2 | Control (Path) 4 Parietal Ctx | 68.8 | 59.5 |

TABLE MC

Panel 1.3D

| Tissue Name | Rel. Exp. (%) Ag2868, Run 162011291 | Tissue Name | Rel. Exp. (%) Ag2868, Run 162011291 | Tissue Name | Rel. Exp. (%) Ag2868, Run 162011291 | Tissue Name | Rel. Exp. (%) Ag2868, Run 162011291 |
|---|---|---|---|---|---|---|---|
| Liver adenocarcinoma | 0.5 | Kidney (fetal) | 9.1 | Adrenal gland | 1.0 | Renal ca. RXF 393 | 2.8 |
| Pancreas | 1.1 | Renal ca. 786-0 | 0.0 | Thyroid | 9.9 | Renal ca. ACHN | 1.5 |
| Pancreatic ca. CAPAN 2 | 1.6 | Renal ca. A498 | 1.1 | Salivary gland | 7.0 | Renal ca. UO-31 | 2.7 |
| | | | | Pituitary gland | 3.0 | Renal ca. TK-10 | 3.4 |
| | | | | Brain (fetal) | 3.3 | Liver | 36.9 |

TABLE MC-continued

Panel 1.3D

| Tissue Name | Rel. Exp. (%) Ag2868, Run 162011291 | Tissue Name | Rel. Exp. (%) Ag2868, Run 162011291 |
|---|---|---|---|
| Brain (whole) | 23.5 | Liver (fetal) | 24.7 |
| Brain (amygdala) | 13.7 | Liver ca. (hepatoblast) HepG2 | 5.0 |
| Brain (cerebellum) | 28.3 | Lung | 1.4 |
| Brain (hippocampus) | 31.6 | Lung (fetal) | 3.4 |
| Brain (substantia nigra) | 8.5 | Lung ca. (small cell) LX-1 | 2.8 |
| Brain (thalamus) | 16.8 | Lung ca. (small cell) NCI-H69 | 7.1 |
| Cerebral Cortex | 100.0 | Lung ca. (s.cell var.) SHP-77 | 3.1 |
| Spinal cord | 10.2 | Lung ca. (large cell)NCI-H460 | 0.3 |
| glio/astro U87-MG | 1.3 | Lung ca. (non-sm. cell) A549 | 0.7 |
| glio/astro U-118-MG | 0.4 | Lung ca. (non-s.cell) NCI-H23 | 0.6 |
| astrocytoma SW1783 | 4.7 | Lung ca. (non-s.cell) HOP-62 | 2.8 |
| neuro*; met SK-N-AS | 1.0 | Lung ca. (non-s.cl) NCI-H522 | 0.4 |
| astrocytoma SF-539 | 6.5 | Lung ca. (squam.) SW 900 | 0.9 |
| astrocytoma SNB-75 | 1.4 | Lung ca. (squam.) NCI-H596 | 3.4 |
| glioma SNB-19 | 11.5 | Mammary gland | 9.9 |
| glioma U251 | 5.1 | Breast ca.* (pl.ef) MCF-7 | 13.3 |
| glioma SF-295 | 0.5 | Breast ca.* (pl.ef) MDA-MB-231 | 3.2 |
| Heart (fetal) | 45.1 | Breast ca.* (pl.ef) T47D | 12.2 |
| Heart | 21.9 | Breast ca. BT-549 | 1.6 |
| Skeletal muscle (fetal) | 27.9 | Breast ca. MDA-N | 3.9 |
| Skeletal muscle | 20.2 | Ovary | 10.4 |
| Bone marrow | 3.5 | Ovarian ca. OVCAR-3 | 4.5 |
| Thymus | 30.1 | Ovarian ca. OVCAR-4 | 2.6 |
| Spleen | 3.0 | Ovarian ca. OVCAR-5 | 3.7 |
| Lymph node | 2.4 | Ovarian ca. OVCAR-8 | 5.3 |
| Colorectal | 52.5 | Ovarian ca. IGROV-1 | 0.7 |
| Stomach | 6.7 | Ovarian ca.* (ascites) SK-OV-3 | 1.0 |
| Small intestine | 17.1 | Uterus | 1.2 |
| Colon ca. SW480 | 9.7 | Placenta | 0.2 |
| Colon ca.* SW620 (SW480 met) | 3.8 | Prostate | 14.5 |
| Colon ca. HT29 | 13.1 | Prostate ca.* (bone met)PC-3 | 1.1 |
| Colon ca. HCT-116 | 3.5 | Testis | 2.3 |
| Colon ca. CaCo-2 | 14.1 | Melanoma Hs688(A).T | 0.1 |
| Colon ca. tissue(ODO3866) | 17.8 | Melanoma* (met) Hs688(B).T | 0.6 |
| Colon ca. HCC-2998 | 18.0 | Melanoma UACC-62 | 0.0 |
| Gastric ca.* (liver met) NCI-N87 | 7.9 | Melanoma M14 | 2.3 |
| Bladder | 5.6 | Melanoma LOX IMVI | 0.2 |
| Trachea | 28.5 | Melanoma* (met) SK-MEL-5 | 0.1 |
| Kidney | 29.9 | Adipose | 1.0 |

TABLE MD

Panel 2D

| Tissue Name | Rel. Exp. (%) Ag2868 Run 162011370 | Tissue Name | Rel. Exp. (%) Ag2868 Run 162011370 |
|---|---|---|---|
| Normal Colon | 43.8 | Kidney Margin 8120608 | 9.7 |
| CC Well to Mod Diff (ODO3866) | 5.9 | Kidney Cancer 8120613 | 31.9 |
| CC Margin (ODO3866) | 8.9 | Kidney Margin 8120614 | 13.8 |
| CC Gr.2 rectosigmoid (ODO3868) | 19.1 | Kidney Cancer 9010320 | 4.9 |
| CC Margin (ODO3868) | 1.4 | Kidney Margin 9010321 | 17.1 |
| CC Mod Diff (ODO3920) | 34.2 | Normal Uterus | 0.3 |
| CC Margin (ODO3920) | 15.7 | Uterus Cancer 064011 | 3.4 |
| CC Gr.2 ascend colon (ODO3921) | 38.4 | Normal Thyroid | 8.0 |
| CC Margin (ODO3921) | 16.0 | Thyroid Cancer 064010 | 7.5 |
| CC from Partial Hepatectomy (ODO4309) Mets | 28.7 | Thyroid Cancer A302152 | 6.8 |
| Liver Margin (ODO4309) | 100.0 | Thyroid Margin A302153 | 8.2 |
| Colon mets to lung (OD04451-01) | 6.7 | Normal Breast | 4.6 |
| Lung Margin (OD04451-02) | 0.8 | Breast Cancer (OD04566) | 12.1 |
| Normal Prostate 6546-1 | 4.1 | Breast Cancer (OD04590-01) | 22.1 |
| Prostate Cancer (OD04410) | 20.3 | Breast Cancer Mets (OD04590-03) | 22.7 |
| Prostate Margin (OD04410) | 16.3 | Breast Cancer Metastasis (OD04655-05) | 23.8 |
| Prostate Cancer (OD04720-01) | 8.4 | Breast Cancer 064006 | 4.8 |
| Prostate Margin (OD04720-02) | 11.2 | Breast Cancer 1024 | 41.2 |
| Normal Lung 061010 | 6.7 | Breast Cancer 9100266 | 16.0 |
| Lung Met to Muscle (ODO4286) | 0.5 | Breast Margin 9100265 | 6.9 |
| Muscle Margin (ODO4286) | 0.3 | Breast Cancer A209073 | 5.5 |
| Lung Malignant Cancer (OD03126) | 10.4 | Breast Margin A2090734 | 7.8 |
| Lung Margin (OD03126) | 4.1 | Normal Liver | 55.5 |
| Lung Cancer (OD04404) | 20.9 | Liver Cancer 064003 | 17.7 |
| Lung Margin (OD04404) | 1.4 | Liver Cancer 1025 | 70.7 |
| Lung Cancer (OD04565) | 3.7 | Liver Cancer 1026 | 20.3 |
| Lung Margin (OD04565) | 1.3 | Liver Cancer 6004-T | 90.1 |
| Lung Cancer (OD04237-01) | 14.2 | Liver Tissue 6004-N | 5.2 |
| Lung Margin (OD04237-02) | 1.0 | Liver Cancer 6005-T | 17.2 |
| Ocular Mel Met to Liver (ODO4310) | 6.8 | Liver Tissue 6005-N | 32.5 |
| Liver Margin (ODO4310) | 58.6 | Normal Bladder | 5.4 |
| Melanoma Mets to Lung (OD04321) | 5.7 | Bladder Cancer 1023 | 2.8 |
| Lung Margin (OD04321) | 2.9 | Bladder Cancer A302173 | 2.5 |

TABLE MD-continued

Panel 2D

| Tissue Name | Rel. Exp. (%) Ag2868 Run 162011370 | Tissue Name | Rel. Exp. (%) Ag2868 Run 162011370 |
|---|---|---|---|
| Normal Kidney | 30.1 | Bladder Cancer (OD04718-01) | 7.2 |
| Kidney Ca, Nuclear grade 2 (OD04338) | 42.9 | Bladder Normal Adjacent (OD04718-03) | 1.4 |
| Kidney Margin (OD04338) | 17.6 | Normal Ovary | 1.5 |
| Kidney Ca Nuclear grade 1/2 (OD04339) | 7.3 | Ovarian Cancer 064008 | 9.6 |
| Kidney Margin (OD04339) | 14.7 | Ovarian Cancer (OD04768-07) | 1.4 |
| Kidney Ca, Clear cell type (OD04340) | 0.3 | Ovary Margin (OD04768-08) | 0.2 |
| Kidney Margin (OD04340) | 14.1 | Normal Stomach | 4.8 |
| Kidney Ca, Nuclear grade 3 (OD04348) | 0.2 | Gastric Cancer 9060358 | 0.6 |
| Kidney Margin (OD04348) | 7.3 | Stomach Margin 9060359 | 5.0 |
| Kidney Cancer (OD04622-01) | 9.3 | Gastric Cancer 9060395 | 7.9 |
| Kidney Margin (OD04622-03) | 4.0 | Stomach Margin 9060394 | 6.8 |
| Kidney Cancer (OD04450-01) | 10.7 | Gastric Cancer 9060397 | 16.8 |
| Kidney Margin (OD04450-03) | 11.7 | Stomach Margin 9060396 | 3.4 |
| Kidney Cancer 8120607 | 2.4 | Gastric Cancer 064005 | 8.0 |

TABLE ME

Panel 4D

| Tissue Name | Rel. Exp. (%) Ag2868, Run 159776784 | Tissue Name | Rel. Exp. (%) Ag2868, Run 159776784 |
|---|---|---|---|
| Secondary Th1 act | 48.0 | HUVEC IL-1beta | 0.1 |
| Secondary Th2 act | 40.9 | HUVEC IFN gamma | 2.7 |
| Secondary Tr1 act | 55.1 | HUVEC TNF alpha + IFN gamma | 0.3 |
| Secondary Th1 rest | 3.1 | HUVEC TNF alpha + IL4 | 1.1 |
| Secondary Th2 rest | 7.8 | HUVEC IL-11 | 2.6 |
| Secondary Tr1 rest | 12.5 | Lung Microvascular EC none | 1.9 |
| Primary Th1 act | 64.6 | Lung Microvascular EC TNFalpha + IL-1beta | 1.8 |
| Primary Th2 act | 52.9 | Microvascular Dermal EC none | 1.0 |
| Primary Tr1 act | 88.3 | Microvasular Dermal EC TNFalpha + IL-1beta | 1.4 |
| Primary Th1 rest | 54.0 | Bronchial epithelium TNFalpha + IL1beta | 1.1 |
| Primary Th2 rest | 30.6 | Small airway epithelium none | 3.8 |
| Primary Tr1 rest | 100.0 | Small airway epithelium TNFalpha + IL-1beta | 14.2 |
| CD45RA CD4 lymphocyte act | 17.0 | Coronery artery SMC rest | 0.3 |
| CD45RO CD4 lymphocyte act | 33.0 | Coronery artery SMC TNFalpha + IL-1beta | 0.0 |
| CD8 lymphocyte act | 30.8 | Astrocytes rest | 3.0 |
| Secondary CD8 lymphocyte rest | 30.8 | Astrocytes TNFalpha + IL-1beta | 1.7 |
| Secondary CD8 lymphocyte act | 16.4 | KU-812 (Basophil) rest | 25.3 |
| CD4 lymphocyte none | 3.5 | KU-812 (Basophil) PMA/ionomycin | 50.0 |
| 2ry Th1/Th2/Tr1_anti-CD95 CH11 | 9.9 | CCD1106 (Keratinocytes) none | 12.7 |
| LAK cells rest | 10.2 | CCD1106 (Keratinocytes) TNFalpha + IL-1beta | 0.5 |
| LAK cells IL-2 | 24.5 | Liver cirrhosis | 3.8 |
| LAK cells IL-2 + IL-12 | 30.4 | Lupus kidney | 2.0 |
| LAK cells IL-2 + IFN gamma | 31.4 | NCI-H292 none | 31.4 |
| LAK cells IL-2 + IL-18 | 33.0 | NCI-H292 IL-4 | 36.1 |
| LAK cells PMA/ionomycin | 1.8 | NCI-H292 IL-9 | 41.8 |
| NK Cells IL-2 rest | 14.5 | NCI-H292 IL-13 | 25.5 |
| Two Way MLR 3 day | 6.4 | NCI-H292 IFN gamma | 23.7 |
| Two Way MLR 5 day | 13.6 | HPAEC none | 1.0 |
| Two Way MLR 7 day | 11.7 | HPAEC TNF alpha + IL-1 beta | 0.2 |
| PBMC rest | 2.0 | Lung fibroblast none | 1.5 |
| PBMC PWM | 43.8 | Lung fibroblast TNF alpha + IL-1 beta | 0.3 |
| PBMC PHA-L | 22.7 | Lung fibroblast IL-4 | 1.0 |
| Ramos (B cell) none | 23.7 | Lung fibroblast IL-9 | 1.9 |
| Ramos (B cell) ionomycin | 62.9 | Lung fibroblast IL-13 | 0.7 |
| B lymphocytes PWM | 76.8 | Lung fibroblast IFN gamma | 0.5 |
| B lymphocytes CD40L and IL-4 | 26.6 | Dermal fibroblast CCD1070 rest | 1.8 |
| EOL-1 dbcAMP | 27.2 | Dermal fibroblast CCD1070 TNF alpha | 31.6 |
| EOL-1 dbcAMP PMA/ionomycin | 12.3 | Dermal fibroblast CCD1070 IL-1 beta | 2.3 |
| Dendritic cells none | 8.1 | Dermal fibroblast IFN gamma | 0.2 |
| Dendritic cells LPS | 3.1 | Dermal fibroblast IL-4 | 2.6 |
| Dendritic cells anti-CD40 | 5.9 | IBD Colitis 2 | 0.6 |
| Monocytes rest | 1.2 | IBD Crohn's | 3.0 |
| Monocytes LPS | 0.9 | Colon | 31.6 |
| Macrophages rest | 15.1 | Lung | 2.9 |
| Macrophages LPS | 1.4 | Thymus | 29.5 |
| HUVEC none | 1.7 | Kidney | 11.9 |
| HUVEC starved | 1.8 | | |

TABLE MF

Panel 5 Islet

| Tissue Name | Rel. Exp. (%) Ag2868, Run 233071460 | Tissue Name | Rel. Exp. (%) Ag2868 Run 233071460 |
|---|---|---|---|
| 97457_Patient-02go_adipose | 1.6 | 94709_Donor 2 AM - A_adipose | 6.4 |
| 97476_Patient-07sk_skeletal muscle | 0.0 | 94710_Donor 2 AM - B_adipose | 0.0 |
| 97477_Patient-07ut_uterus | 3.5 | 94711_Donor 2 AM - C_adipose | 0.0 |
| 97478_Patient-07pl_placenta | 9.4 | 94712_Donor 2 AD - A_adipose | 4.0 |
| 99167_Bayer Patient 1 | 12.2 | 94713_Donor 2 AD - B_adipose | 2.0 |
| 97482_Patient-08ut_uterus | 0.7 | 94714_Donor 2 AD - C_adipose | 0.0 |
| 97483_Patient-08pl_placenta | 4.0 | 94742_Donor 3 U - A_Mesenchymal Stem Cells | 0.0 |
| 97486_Patient-09sk_skeletal muscle | 0.0 | 94743_Donor 3 U - B_Mesenchymal Stem Cells | 0.0 |
| 97487_Patient-09ut_uterus | 4.0 | 94730_Donor 3 AM - A_adipose | 3.9 |
| 97488_Patient-09pl_placenta | 9.8 | 94731_Donor 3 AM - B_adipose | 1.7 |
| 97492_Patient-10ut_uterus | 6.6 | 94732_Donor 3 AM - C_adipose | 4.1 |
| 97493_Patient-10pl_placenta | 6.1 | 94733_Donor 3 AD - A_adipose | 1.2 |
| 97495_Patient-11go_adipose | 7.5 | 94734_Donor 3 AD - B_adipose | 2.0 |
| 97496_Patient-11sk_skeletal muscle | 12.5 | 94735_Donor 3 AD - C_adipose | 3.7 |
| 97497_Patient-11ut_uterus | 3.9 | 77138_Liver_HepG2untreated | 85.3 |
| 97498_Patient-11pl_placenta | 5.0 | 73556_Heart_Cardiac stromal cells (primary) | 0.0 |
| 97500_Patient-12go_adipose | 13.8 | 81735_Small Intestine | 58.2 |
| 97501_Patient-12sk_skeletal muscle | 20.6 | 72409_Kidney_Proximal Convoluted Tubule | 11.6 |
| 97502_Patient-12ut_uterus | 1.3 | 82685_Small intestine_Duodenum | 58.2 |
| 97503_Patient-12pl_placenta | 2.1 | 90650_Adrenal_Adrenocortical adenoma | 5.4 |
| 94721_Donor 2 U - A_Mesenchymal Stem Cells | 2.9 | 72410_Kidney_HRCE | 100.0 |
| 94722_Donor 2 U - B_Mesenchymal Stem Cells | 1.5 | 72411_Kidney_HRE | 35.1 |
| 94723_Donor 2 U - C_Mesenchymal Stem Cells | 3.3 | 73139_Uterus_Uterine smooth muscle cells | 0.0 |

CNS_neurodegeneration_v1.0 Summary: Ag2868 No association is evident between the CG56001-01 gene expression levels and Alzheimer's disease. This is not surprising however, because D-beta-hydroxybutyrate dehydrogenase function appears to be controlled, at the translational, post-translational and catalytic levels. (See ref. below). This panel confirms expression of this gene in the brain. See Panel 1.3D for discussion of utility of this gene in the central nervous system.

Panel 1.3D Summary: Ag2868 Expression of the CG56001-01 gene is highest in the cerebral cortex (CT=27.6). The expression of this gene in multiple brain regions is consistent with a published role for this gene in CNS energetic processes. D-beta-hydroxybutyrate protects neurons in models of Alzheimer's and Parkinson's disease. Other enzymes, such as amyloid beta-peptide-binding alcohol dehydrogenase, which have been shown to possess D-beta-hydroxybutyrate dehydrogenase activity, contribute to the protective response to metabolic stress, especially in the setting of ischemia. Since this gene product processes D-beta-hydroxybutyrate to provide a neuronal energy source, activators of the protein encoded by this gene may be useful in treating and protecting the CNS of Alzheimer's and Parkinson's disease patients, as well as stroke.

Overall, expression of this gene appears to be largely associated with normal tissues when compared to cancer cell lines. Thus, the expression of this gene could be used to distinguish normal tissues from the other tissues in the panel. Moreover, therapeutic modulation of this gene, through the use of small molecule drugs, antibodies or protein therapeutics might be of benefit in the treatment of cancer.

This gene is also moderately expressed in a variety of metabolic tissues, including pancreas, adrenal, thyroid, pituitary, adult and fetal heart, adult and fetal skeletal muscle, adult and fetal liver and adipose. This gene encodes a hydroxybutyrate dehydrogenase homolog. Mutations in this fatty acid-oxidation enzyme are associated with hypoglycemia and cardiac arrest. Activators of this enzyme could be drug targets for obesity because increased fatty acid oxidation may prevent the incorporation of fatty acids into triglycerides, thus decreasing adipose mass.

Panel 2D Summary: Ag2868 The expression of the CG56001-01 gene appears to be highest in a sample derived from normal liver tissue adjacent to a metastatic colon cancer (CT=25.9). In addition, there appears to be substantial expression associated with malignant liver tissue when compared to their associated normal adjacent tissue. Thus, the expression of this gene could be used to distinguish liver derived tissue from the other samples in the panel. Moreover, therapeutic modulation of this gene, through the use of small molecule drugs, antibodies or protein therapeutics might be of benefit in the treatment of liver cancer.

Panel 4D Summary: Ag2868 The CG56001-01 transcript is expressed primarily in activated leukocytes, especially in T cells and B cells (CTs=27–30). It is also expressed in NCI-H292 cells and in TNF alpha treated dermal fibroblasts. The protein encoded by this transcript has homology to hydroxybutyrate dehydrogenase, a protein that has been found in lymphocytes (ref below). Thus, the protein encoded for by this transcript may be important for cellular responses to inflammatory/activating stimuli. Therefore, therapeutics designed with the protein encoded for by this transcript could be used for the treatment of inflammatory diseases such as asthma, emphysema, COPD, arthritis, IBD and psoriasis.

Panel 5 Islet Summary: Ag2868 Expression of the CG56001-01 gene is highest a in kidney cell line (CT=32.8). Thus, expression of this gene could be used to differentiate between this sample and other samples on this panel.

N. SC145665404_A/CG55069-01 (NOV15a) and CG55069-02 (NOV15b) and CG55069-03 (NOV15c): TEN-M3 Like Expression of gene SC145665404_A and variants CG55069-02 and CG55069-03 was assessed using the primer-probe sets Ag2674, Ag1479 and Ag2820, described in Tables NA, NB and NC. Results of the RTQ-PCR runs are shown in Tables ND, NE, NF, and NG.

TABLE NA

Probe Name Ag2674

| Primers | Sequences | Start Position | SEQ ID NO |
|---|---|---|---|
| Forward | 5'-acctactcggccactacctaga-3' | 993 | 317 |
| Probe | TET-5'-caccctatcaagaagtgcttttaaattca-3'-TAMRA | 1017 | 318 |
| Reverse | 5'-cagtgcatttccagctacagta-3' | 1060 | 319 |

TABLE NB

Probe Name Ag1479

| Primers | Sequences | Start Position | SEQ ID NO |
|---|---|---|---|
| Forward | 5'-cacggaacgtatcttcaagaaa-3' | 2125 | 320 |
| Probe | TET-5'-ctgcacgtgtgaccctaactggactg-3'-TAMRA | 2154 | 321 |
| Reverse | 5'-gccacagtccacagaacatatt-3' | 2199 | 322 |

TABLE NC

Probe Name Ag2820

| Primers | Sequences | Start Position | SEQ ID NO |
|---|---|---|---|
| Forward | 5'-cagagaagcagacgagttcact-3' | 354 | 323 |
| Probe | TET-5'-caaggacagaattttaccctaaggca-3'-TAMRA | 379 | 324 |
| Reverse | 5'-gttgctggttcacaaactccta-3' | 407 | 325 |

TABLE ND

CNS_neurodegeneration_v1.0

| Tissue Name | Rel. Exp. (%) Ag2674, Run 206976322 | Rel. Exp. (%) Ag2674, Run 237982180 | Tissue Name | Rel. Exp. (%) Ag2674, Run 206976322 | Rel. Exp. (%) Ag2674, Run 237982180 |
|---|---|---|---|---|---|
| AD 1 Hippo | 20.7 | 20.9 | Control (Path) 3 Temporal Ctx | 12.1 | 10.2 |
| AD 2 Hippo | 31.4 | 30.4 | Control (Path) 4 Temporal Ctx | 39.5 | 37.1 |
| AD 3 Hippo | 18.9 | 9.7 | AD 1 Occipital Ctx | 11.5 | 11.9 |
| AD 4 Hippo | 7.9 | 6.8 | AD 2 Occipital Ctx (Missing) | 0.0 | 0.0 |
| AD 5 hippo | 100.0 | 60.3 | AD 3 Occipital Ctx | 7.9 | 6.0 |
| AD 6 Hippo | 62.9 | 61.6 | AD 4 Occipital Ctx | 15.4 | 17.8 |
| Control 2 Hippo | 34.9 | 29.9 | AD 5 Occipital Ctx | 0.0 | 34.4 |
| Control 4 Hippo | 15.6 | 8.3 | AD 6 Occipital Ctx | 40.3 | 28.9 |
| Control (Path) 3 Hippo | 18.3 | 19.3 | Control 1 Occipital Ctx | 7.4 | 4.5 |

TABLE ND-continued

CNS_neurodegeneration_v1.0

| Tissue Name | Rel. Exp. (%) Ag2674, Run 206976322 | Rel. Exp. (%) Ag2674, Run 237982180 | Tissue Name | Rel. Exp. (%) Ag2674, Run 206976322 | Rel. Exp. (%) Ag2674, Run 237982180 |
|---|---|---|---|---|---|
| AD 1 Temporal Ctx | 21.2 | 16.2 | Control 2 Occipital Ctx | 42.9 | 28.3 |
| AD 2 Temporal Ctx | 39.0 | 38.4 | Control 3 Occipital Ctx | 18.8 | 17.1 |
| AD 3 Temporal Ctx | 14.8 | 9.9 | Control 4 Occipital Ctx | 9.1 | 7.6 |
| AD 4 Temporal Ctx | 26.4 | 32.1 | Control (Path) 1 Occipital Ctx | 72.2 | 46.7 |
| AD 5 Inf Temporal Ctx | 84.7 | 100.0 | Control (Path) 2 Occipital Ctx | 13.7 | 14.3 |
| AD 5 SupTemporal Ctx | 35.4 | 59.5 | Control (Path) 3 Occipital Ctx | 6.4 | 6.3 |
| AD 6 Inf Temporal Ctx | 64.6 | 54.0 | Control (Path) 4 Occipital Ctx | 16.2 | 13.1 |
| AD 6 Sup Temporal Ctx | 54.0 | 44.8 | Control 1 Parietal Ctx | 12.0 | 8.7 |
| Control 1 Temporal Ctx | 19.8 | 13.9 | Control 2 Parietal Ctx | 46.3 | 49.3 |
| Control 2 Temporal Ctx | 47.0 | 30.1 | Control 3 Parietal Ctx | 17.7 | 19.2 |
| Control 3 Temporal Ctx | 35.4 | 31.4 | Control (Path) 1 Parietal Ctx | 59.5 | 48.6 |
| Control 4 Temporal Ctx | 16.5 | 16.6 | Control (Path) 2 Parietal Ctx | 25.5 | 25.3 |
| Control (Path) 1 Temporal Ctx | 63.3 | 50.0 | Control (Path) 3 Parietal Ctx | 6.9 | 7.7 |
| Control (Path) 2 Temporal Ctx | 31.6 | 34.2 | Control (Path) 4 Parietal Ctx | 31.2 | 30.1 |

TABLE NE

Panel 1.3D

| Tissue Name | Rel. Exp. (%) Ag1479, Run 165520101 | Rel. Exp. (%) Ag2674, Run 162554642 | Rel. Exp. (%) Ag2820, Run 165527000 | Rel. Exp. (%) Ag2820, Run 165544916 |
|---|---|---|---|---|
| Liver adenocarcinoma | 16.0 | 15.9 | 17.2 | 8.2 |
| Pancreas | 0.5 | 0.1 | 0.0 | 0.1 |
| Pancreatic ca. CAPAN 2 | 16.2 | 4.9 | 10.4 | 6.3 |
| Adrenal gland | 4.1 | 0.8 | 4.9 | 2.7 |
| Thyroid | 2.0 | 0.8 | 0.6 | 0.2 |
| Salivary gland | 0.2 | 0.1 | 0.0 | 0.1 |
| Pituitary gland | 3.5 | 0.6 | 0.8 | 0.1 |
| Brain (fetal) | 8.7 | 0.6 | 2.3 | 1.1 |
| Brain (whole) | 10.4 | 2.0 | 1.7 | 2.1 |
| Brain (amygdala) | 12.8 | 3.0 | 2.0 | 2.0 |
| Brain (cerebellum) | 10.0 | 1.8 | 0.3 | 0.3 |
| Brain (hippocampus) | 17.7 | 5.0 | 3.5 | 2.1 |
| Brain (substantia nigra) | 1.8 | 0.0 | 0.4 | 0.1 |
| Brain (thalamus) | 19.3 | 2.2 | 2.2 | 3.2 |
| Cerebral Cortex | 8.0 | 100.0 | 4.8 | 3.6 |

TABLE NE-continued

Panel 1.3D

| Tissue Name | Rel. Exp. (%) Ag1479, Run 165520101 | Rel. Exp. (%) Ag2674, Run 162554642 | Rel. Exp. (%) Ag2820, Run 165527000 | Rel. Exp. (%) Ag2820, Run 165544916 |
|---|---|---|---|---|
| Spinal cord | 1.4 | 1.1 | 0.4 | 1.0 |
| glio/astro U87-MG | 13.6 | 12.0 | 18.8 | 26.1 |
| glio/astro U-118-MG | 82.4 | 20.9 | 100.0 | 100.0 |
| astrocytoma SW1783 | 27.9 | 21.5 | 24.8 | 19.3 |
| neuro*; met SK-N-AS | 31.2 | 8.7 | 18.8 | 16.3 |
| astrocytoma SF-539 | 25.2 | 19.8 | 22.2 | 19.3 |
| astrocytoma SNB-75 | 20.6 | 5.2 | 27.2 | 15.7 |
| glioma SNB-19 | 4.7 | 1.6 | 4.0 | 3.4 |
| glioma U251 | 100.0 | 7.9 | 88.3 | 76.8 |
| glioma SF-295 | 5.6 | 3.3 | 5.6 | 3.5 |
| Heart (fetal) | 1.0 | 4.3 | 0.3 | 0.3 |
| Heart | 0.7 | 0.3 | 0.0 | 0.0 |
| Skeletal muscle (fetal) | 1.0 | 32.8 | 2.3 | 1.3 |
| Skeletal muscle | 6.0 | 2.0 | 0.0 | 0.2 |
| Bone marrow | 0.0 | 0.0 | 0.0 | 0.0 |
| Thymus | 0.2 | 0.7 | 0.5 | 0.6 |
| Spleen | 0.7 | 0.3 | 1.0 | 0.9 |
| Lymph node | 2.0 | 0.2 | 2.4 | 2.0 |
| Colorectal | 0.3 | 3.2 | 0.5 | 0.1 |
| Stomach | 3.4 | 0.1 | 2.2 | 0.1 |
| Small intestine | 3.5 | 0.6 | 1.3 | 0.7 |
| Colon ca. SW480 | 1.6 | 0.7 | 2.4 | 2.0 |
| Colon ca.* SW620 (SW480 met) | 0.0 | 0.0 | 0.0 | 0.0 |
| Colon ca. HT29 | 0.7 | 0.7 | 0.6 | 0.8 |
| Colon ca. HCT-116 | 0.3 | 0.0 | 0.0 | 0.1 |
| Colon ca. CaCo-2 | 8.6 | 14.3 | 9.7 | 7.4 |
| Colon ca. tissue(ODO3866) | 2.6 | 2.5 | 2.6 | 1.4 |
| Colon ca. HCC-2998 | 1.0 | 0.4 | 2.4 | 1.2 |
| Gastric ca.* (liver met) NCI-N87 | 0.9 | 0.3 | 2.4 | 0.6 |
| Bladder | 0.9 | 2.5 | 2.3 | 0.4 |
| Trachea | 0.8 | 0.3 | 0.0 | 0.2 |
| Kidney | 0.8 | 0.5 | 0.0 | 0.0 |
| Kidney (fetal) | 2.8 | 1.4 | 2.5 | 1.3 |
| Renal ca. 786-0 | 11.2 | 6.4 | 19.9 | 9.5 |
| Renal ca. A498 | 13.1 | 4.3 | 13.2 | 7.2 |
| Renal ca. RXF 393 | 21.5 | 7.2 | 21.3 | 26.1 |
| Renal ca. ACHN | 10.1 | 5.1 | 7.6 | 7.5 |
| Renal ca. UO-31 | 10.2 | 3.3 | 13.8 | 9.5 |
| Renal ca. TK-10 | 0.0 | 0.0 | 0.0 | 0.0 |
| Liver | 0.0 | 0.0 | 0.0 | 0.0 |
| Liver (fetal) | 0.1 | 0.0 | 0.0 | 0.0 |
| Liver ca. (hepatoblast) HepG2 | 0.2 | 0.2 | 0.0 | 0.4 |
| Lung | 0.4 | 0.1 | 0.2 | 0.0 |
| Lung (fetal) | 0.3 | 0.3 | 0.0 | 0.7 |
| Lung ca. (small cell) LX-1 | 0.0 | 0 0 | 0.0 | 0.0 |
| Lung ca. (small cell) NCI-H69 | 3.1 | 11.6 | 5.4 | 11.2 |
| Lung ca. (s.cell var.) SHP-77 | 2.4 | 1.7 | 0.0 | 0.0 |
| Lung ca. (large cell) NCI-H460 | 18.6 | 2.6 | 26.1 | 12.9 |
| Lung ca. (non-sm. cell) A549 | 0.4 | 0.1 | 0.6 | 0.2 |
| Lung ca. (non-s.cell) NCI-H23 | 1.4 | 2.1 | 1.2 | 0.1 |
| Lung ca. (non-s.cell) HOP-62 | 9.5 | 3.9 | 16.0 | 6.8 |
| Lung ca. (non-s.cl) NCI-H522 | 28.1 | 36.9 | 15.3 | 5.8 |
| Lung ca. (squam.) SW 900 | 0.6 | 0.1 | 0.2 | 0.1 |
| Lung ca. (squam.) NCI-H596 | 16.5 | 8.0 | 19.2 | 12.3 |
| Mammary gland | 0.7 | 0.5 | 0.5 | 0.2 |
| Breast ca.* (pl.ef) | 5.0 | 8.8 | 5.1 | 2.1 |

TABLE NE-continued

Panel 1.3D

| Tissue Name | Rel. Exp. (%) Ag1479, Run 165520101 | Rel. Exp. (%) Ag2674, Run 162554642 | Rel. Exp. (%) Ag2820, Run 165527000 | Rel. Exp. (%) Ag2820, Run 165544916 |
|---|---|---|---|---|
| MCF-7 Breast ca.* (pl.ef) | 2.4 | 0.3 | 0.5 | 0.4 |
| MDA-MB-231 Breast ca.* (pl.ef) | 53.6 | 26.1 | 1.9 | 1.1 |
| T47D Breast ca. BT-549 | 0.0 | 0.0 | 0.0 | 0.0 |
| Breast ca. MDA-N | 0.8 | 1.1 | 1.5 | 1.1 |
| Ovary | 0.8 | 2.8 | 0.3 | 0.0 |
| Ovarian ca. OVCAR-3 | 58.6 | 19.3 | 26.8 | 20.0 |
| Ovarian ca. OVCAR-4 | 2.4 | 0.4 | 3.1 | 2.0 |
| Ovarian ca. OVCAR-5 | 0.0 | 0.0 | 0.0 | 0.0 |
| Ovarian ca. OVCAR-8 | 8.7 | 6.7 | 1.7 | 2.8 |
| Ovarian ca. IGROV-1 | 3.1 | 1.5 | 0.0 | 0.4 |
| Ovarian ca.* (ascites) SK-OV-3 | 27.9 | 6.7 | 22.2 | 0.0 |
| Uterus | 2.4 | 0.4 | 1.2 | 0.9 |
| Placenta | 8.1 | 4.4 | 7.7 | 4.1 |
| Prostate | 2.1 | 0.1 | 0.0 | 0.0 |
| Prostate ca.* (bone met)PC-3 | 0.7 | 1.1 | 0.0 | 0.0 |
| Testis | 4.5 | 1.1 | 0.0 | 0.1 |
| Melanoma Hs688(A).T | 10.0 | 20.4 | 12.8 | 7.5 |
| Melanoma* (met) Hs688(B).T | 12.5 | 18.9 | 12.0 | 42 |
| Melanoma UACC-62 | 1.2 | 0.3 | 0.4 | 0.3 |
| Melanoma M14 | 13.7 | 2.1 | 14.4 | 7.8 |
| Melanoma LOX IMVI | 1.2 | 1.2 | 0.0 | 0.0 |
| Melanoma* (met) SK-MEL-5 | 3.7 | 4.5 | 3.8 | 1.8 |
| Adipose | 3.6 | 4.5 | 12.9 | 0.6 |

TABLE NF

Panel 2D

| Tissue Name | Rel. Exp. (%) Ag2674, Run 162455917 | Rel. Exp. (%) Ag2820, Run 163578010 | Rel. Exp. (%) Ag2820, Run 165910586 | Tissue Name | Rel. Exp. (%) Ag2674, Run 162455917 | Rel. Exp. (%) Ag2820, Run 163578010 | Rel. Exp. (%) Ag2820, Run 165910586 |
|---|---|---|---|---|---|---|---|
| Normal Colon | 47.6 | 12.4 | 15.7 | Kidney Margin 8120608 | 6.9 | 1.7 | 3.7 |
| CC Well to Mod Diff (ODO3866) | 8.4 | 7.2 | 7.4 | Kidney Cancer 8120613 | 0.5 | 0.0 | 0.0 |
| CC Margin (ODO3866) | 8.0 | 0.8 | 0.4 | Kidney Margin 8120614 | 2.8 | 1.6 | 0.0 |
| CC Gr.2 rectosigmoid (ODO3868) | 5.4 | 3.8 | 2.3 | Kidney Cancer 9010320 | 22.4 | 39.5 | 36.1 |
| CC Margin (ODO3868) | 12.4 | 2.2 | 1.2 | Kidney Margin 9010321 | 14.1 | 22.5 | 11.6 |
| CC Mod Diff (ODO3920) | 0.4 | 0.7 | 0.0 | Normal Uterus | 7.1 | 4.1 | 7.0 |
| CC Margin (ODO3920) | 12.2 | 1.6 | 1.4 | Uterus Cancer 064011 | 38.4 | 5.5 | 2.3 |
| CC Gr.2 | 3.8 | 2.9 | 3.6 | Normal | 13.9 | 4.7 | 1.1 |

TABLE NF-continued

Panel 2D

| Tissue Name | Rel. Exp. (%) Ag2674, Run 162455917 | Rel. Exp. (%) Ag2820, Run 163578010 | Rel. Exp. (%) Ag2820, Run 165910586 | Tissue Name | Rel. Exp. (%) Ag2674, Run 162455917 | Rel. Exp. (%) Ag2820, Run 163578010 | Rel. Exp. (%) Ag2820, Run 165910586 |
|---|---|---|---|---|---|---|---|
| ascend colon (OD03921) | | | | Thyroid | | | |
| CC Margin (OD03921) | 8.9 | 1.3 | 0.0 | Thyroid Cancer 064010 | 30.4 | 36.3 | 40.9 |
| CC from Partial Hepatectomy (OD04309) Mets | 6.0 | 12.3 | 12.5 | Thyroid Cancer A302152 | 8.3 | 5.8 | 2.8 |
| Liver Margin (OD04309) | 0.4 | 0.4 | 0.0 | Thyroid Margin A302153 | 88.3 | 10.0 | 7.2 |
| Colon mets to lung (OD04451-01) | 1.4 | 1.5 | 1.1 | Normal Breast | 26.4 | 9.5 | 11.3 |
| Lung Margin (OD04451-02) | 0.7 | 0.0 | 0.8 | Breast Cancer (OD04566) | 2.0 | 0.7 | 0.8 |
| Normal Prostate 6546-1 | 14.1 | 6.3 | 2.0 | Breast Cancer (OD04590-01) | 13.7 | 4.0 | 2.9 |
| Prostate Cancer (OD04410) | 26.8 | 4.9 | 4.1 | Breast Cancer Mets (OD04590-03) | 55.1 | 32.5 | 15.9 |
| Prostate Margin (OD04410) | 27.0 | 6.0 | 1.9 | Breast Cancer Metastasis (OD04655-05) | 24.8 | 12.2 | 2.9 |
| Prostate Cancer (OD04720-01) | 18.8 | 3.2 | 1.2 | Breast Cancer 064006 | 11.2 | 7.5 | 5.5 |
| Prostate Margin (OD04720-02) | 41.2 | 8.0 | 3.9 | Breast Cancer 1024 | 11.1 | 1.8 | 1.3 |
| Normal Lung 061010 | 16.0 | 13.4 | 11.8 | Breast Cancer 9100266 | 11.8 | 3.5 | 1.2 |
| Lung Met to Muscle (OD04286) | 25.5 | 64.2 | 39.2 | Breast Margin 9100265 | 13.2 | 4.9 | 1.7 |
| Muscle Margin (OD04286) | 14.1 | 1.3 | 1.1 | Breast Cancer A209073 | 19.2 | 3.5 | 1.7 |
| Lung Malignant Cancer (OD03126) | 44.8 | 66.9 | 57.8 | Breast Margin A2090734 | 25.3 | 0.6 | 2.0 |
| Lung Margin (OD03126) | 11.7 | 10.6 | 5.9 | Normal Liver | 1.7 | 1.2 | 0.3 |
| Lung Cancer (OD04404) | 13.7 | 10.4 | 11.6 | Liver Cancer 064003 | 0.5 | 0.0 | 0.0 |
| Lung Margin (OD04404) | 11.4 | 10.7 | 14.4 | Liver Cancer 1025 | 0.0 | 0.0 | 0.0 |
| Lung Cancer (OD04565) | 13.1 | 8.5 | 4.5 | Liver Cancer 1026 | 0.7 | 0.0 | 0.0 |
| Lung Margin (OD04565) | 3.1 | 5.3 | 6.2 | Liver Cancer 6004-T | 0.5 | 0.0 | 0.0 |
| Lung Cancer (OD04237- | 7.4 | 13.6 | 4.5 | Liver Tissue | 0.6 | 1.0 | 0.3 |

TABLE NF-continued

Panel 2D

| Tissue Name | Rel. Exp. (%) Ag2674, Run 162455917 | Rel. Exp. (%) Ag2820, Run 163578010 | Rel. Exp. (%) Ag2820, Run 165910586 | Tissue Name | Rel. Exp. (%) Ag2674, Run 162455917 | Rel. Exp. (%) Ag2820, Run 163578010 | Rel. Exp. (%) Ag2820, Run 165910586 |
|---|---|---|---|---|---|---|---|
| 01) Lung Margin (OD04237-02) | 4.8 | 5.3 | 3.8 | 6004-N Liver Cancer 6005-T | 1.1 | 0.0 | 0.0 |
| Ocular Mel Met to Liver (ODO4310) | 0.9 | 0.0 | 0.0 | Liver Tissue 6005-N | 0.0 | 0.0 | 0.0 |
| Liver Margin (ODO4310) | 5.0 | 0.0 | 0.3 | Normal Bladder | 26.1 | 14.7 | 12.7 |
| Melanoma Mets to Lung (OD04321) | 29.7 | 57.4 | 31.6 | Bladder Cancer 1023 | 6.0 | 9.2 | 2.0 |
| Lung Margin (OD04321) | 4.3 | 7.0 | 3.5 | Bladder Cancer A302173 | 6.0 | 3.9 | 2.3 |
| Normal Kidney | 27.7 | 18.9 | 14.4 | Bladder Cancer (OD04718-01) | 41.8 | 89.5 | 82.4 |
| Kidney Ca, Nuclear grade 2 (OD04338) | 2.9 | 5.6 | 2.9 | Bladder Normal Adjacent (OD04718-03) | 22.4 | 3.5 | 3.9 |
| Kidney Margin (OD04338) | 11.8 | 10.8 | 9.0 | Normal Ovary | 10.1 | 2.1 | 0.6 |
| Kidney Ca Nuclear grade 1/2 (OD04339) | 48.3 | 82.4 | 67.8 | Ovarian Cancer 064008 | 100.0 | 36.3 | 100.0 |
| Kidney Margin (OD04339) | 15.9 | 17.7 | 8.8 | Ovarian Cancer (OD04768-07) | 0.3 | 0.0 | 0.4 |
| Kidney Ca, Clear cell type (OD04340) | 0.8 | 0.0 | 0.3 | Ovary Margin (OD04768-08) | 8.2 | 6.9 | 4.4 |
| Kidney Margin (OD04340) | 21.6 | 13.9 | 8.0 | Normal Stomach | 5.7 | 2.2 | 1.9 |
| Kidney Ca, Nuclear grade 3 (OD04348) | 33.4 | 84.7 | 58.2 | Gastric Cancer 9060358 | 7.2 | 3.0 | 2.8 |
| Kidney Margin (OD04348) | 12.9 | 4.6 | 11.1 | Stomach Margin 9060359 | 4.9 | 0.7 | 1.5 |
| Kidney Cancer (OD04622-01) | 1.4 | 0.0 | 4.6 | Gastric Cancer 9060395 | 6.5 | 1.9 | 1.8 |
| Kidney Margin (OD04622-03) | 7.3 | 3.9 | 1.1 | Stomach Margin 9060394 | 7.2 | 2.2 | 2.3 |
| Kidney Cancer (OD04450-01) | 84.7 | 100.0 | 78.5 | Gastric Cancer 9060397 | 46.7 | 22.7 | 28.5 |
| Kidney Margin (OD04450-03) | 19.9 | 12.0 | 6.9 | Stomach Margin 9060396 | 4.7 | 0.7 | 0.0 |
| Kidney Cancer 8120607 | 12.7 | 4.9 | 4.2 | Gastric Cancer 064005 | 5.6 | 9.2 | 6.5 |

TABLE NG

| | Panel 4D | | | |
|---|---|---|---|---|
| Tissue Name | Rel. Exp. (%) Ag1479, Run 162599612 | Rel. Exp. (%) Ag2674, Run 160645450 | Rel. Exp. (%) Ag2820, Run 162350531 | Rel. Exp. (%) Ag2820, Run 164329602 |
| Secondary Th1 act | 0.3 | 0.0 | 0.0 | 0.0 |
| Secondary Th2 act | 0.0 | 0.0 | 0.0 | 0.5 |
| Secondary Tr1 act | 0.0 | 0.0 | 0.0 | 0.3 |
| Secondary Th1 rest | 0.0 | 0.0 | 0.0 | 0.0 |
| Secondary Th2 rest | 0.0 | 0.0 | 0.0 | 0.0 |
| Secondary Tr1 rest | 0.0 | 0.0 | 0.0 | 0.0 |
| Primary Th1 act | 0.0 | 0.0 | 0.0 | 0.0 |
| Primary Th2 act | 0.0 | 0.0 | 0.0 | 0.0 |
| Primary Tr1 act | 0.0 | 0.0 | 0.0 | 0.0 |
| Primary Th1 rest | 0.0 | 0.5 | 0.0 | 0.0 |
| Primary Th2 rest | 0.0 | 0.0 | 0.0 | 0.0 |
| Primary Tr1 rest | 0.0 | 0.0 | 0.0 | 0.0 |
| CD45RA CD4 lymphocyte act | 1.8 | 1.0 | 1.6 | 0.8 |
| CD45RO CD4 lymphocyte act | 0.0 | 0.0 | 0.0 | 0.0 |
| CD8 lymphocyte act | 0.0 | 0.0 | 0.0 | 0.0 |
| Secondary CD8 lymphocyte rest | 0.0 | 0.0 | 0.0 | 0.0 |
| Secondary CD8 lymphocyte act | 0.0 | 0.0 | 0.0 | 0.0 |
| CD4 lymphocyte none | 0.0 | 0.0 | 0.0 | 0.0 |
| 2ry Th1/Th2/Tr1_anti-CD95 CH11 | 0.0 | 0.0 | 0.0 | 0.0 |
| LAK cells rest | 0.0 | 0.0 | 0.0 | 0.0 |
| LAK cells IL-2 | 0.0 | 0.0 | 0.3 | 0.0 |
| LAK cells IL-2 + IL-12 | 0.0 | 0.0 | 0.0 | 0.7 |
| LAK cells IL-2 + IFN gamma | 0.0 | 0.0 | 0.0 | 0.0 |
| LAK cells IL-2 + IL-18 | 0.0 | 0.0 | 0.0 | 0.0 |
| LAK cells PMA/ionomycin | 0.0 | 0.0 | 0.0 | 0.5 |
| NK Cells IL-2 rest | 0.0 | 0.0 | 0.0 | 0.0 |
| Two Way MLR 3 day | 0.0 | 0.0 | 0.0 | 0.0 |
| Two Way MLR 5 day | 0.0 | 0.0 | 0.0 | 0.0 |
| Two Way MLR 7 day | 0.0 | 0.0 | 0.0 | 0.0 |
| PBMC rest | 0.0 | 0.0 | 0.0 | 0.0 |
| PBMC PWM | 0.0 | 0.0 | 0.0 | 0.0 |
| PBMC PHA-L | 0.0 | 0.0 | 0.0 | 0.0 |
| Ramos (B cell) none | 0.0 | 0.0 | 0.0 | 0.0 |
| Ramos (B cell) ionomycin | 0.0 | 0.0 | 0.0 | 0.0 |
| B lymphocytes PWM | 0.0 | 0.0 | 0.3 | 2.5 |
| B lymphocytes CD40L and IL-4 | 0.2 | 0.4 | 0.0 | 0.0 |
| EOL-1 dbcAMP | 0.2 | 0.2 | 0.3 | 0.7 |
| EOL-1 dbcAMP PMA/ionomycin | 0.1 | 0.2 | 0.9 | 0.0 |
| Dendritic cells none | 0.0 | 0.0 | 0.0 | 0.0 |
| Dendritic cells LPS | 0.0 | 0.0 | 0.0 | 0.0 |
| Dendritic cells anti-CD40 | 0.0 | 0.0 | 0.0 | 0.0 |
| Monocytes rest | 0.0 | 0.0 | 0.0 | 0.0 |
| Monocytes LPS | 0.0 | 0.0 | 0.0 | 0.0 |
| Macrophages rest | 0.0 | 0.0 | 0.0 | 0.0 |
| Macrophages LPS | 0.0 | 0.0 | 0.0 | 0.0 |
| HUVEC none | 23.0 | 17.7 | 0.0 | 0.0 |
| HUVEC starved | 25.0 | 26.1 | 0.0 | 0.0 |
| HUVEC IL-1beta | 8.1 | 7.1 | 0.0 | 0.0 |
| HUVEC IFN gamma | 14.8 | 13.8 | 0.0 | 0.3 |
| HUVEC TNF alpha + IFN gamma | 8.1 | 6.7 | 0.0 | 0.0 |
| HUVEC TNF alpha + IL4 | 12.0 | 10.2 | 0.0 | 0.0 |
| HUVEC IL-11 | 8.5 | 7.0 | 0.0 | 0.0 |
| Lung Microvascular EC none | 11.1 | 14.2 | 0.0 | 0.0 |
| Lung Microvascular EC TNFalpha + IL-1beta | 9.3 | 11.0 | 0.0 | 0.2 |
| Microvasular Dermal EC none | 100.0 | 75.3 | 0.0 | 0.0 |
| Microvasular Dermal EC TNFalpha + IL- | 29.7 | 26.8 | 0.0 | 0.0 |

TABLE NG-continued

Panel 4D

| Tissue Name | Rel. Exp. (%) Ag1479, Run 162599612 | Rel. Exp. (%) Ag2674, Run 160645450 | Rel. Exp. (%) Ag2820, Run 162350531 | Rel. Exp. (%) Ag2820, Run 164329602 |
|---|---|---|---|---|
| Bronchial epithelium TNFalpha + IL1beta | 0.2 | 1.3 | 2.4 | 19.9 |
| Small airway epithelium none | 2.2 | 1.1 | 1.0 | 1.7 |
| Small airway epithelium TNFalpha + IL-1beta | 0.3 | 0.2 | 0.0 | 0.0 |
| Coronery artery SMC rest | 8.3 | 8.0 | 1.9 | 2.6 |
| Coronery artery SMC TNFalpha + IL-1beta | 4.6 | 3.1 | 3.0 | 1.2 |
| Astrocytes rest | 85.9 | 70.2 | 100.0 | 100.0 |
| Astrocytes TNFalpha + IL-1beta | 59.0 | 100.0 | 71.7 | 65.5 |
| KU-812 (Basophil) rest | 0.0 | 0.3 | 0.0 | 0.0 |
| KU-812 (Basophil) PMA/ionomycin | 0.0 | 0.0 | 0.0 | 0.0 |
| CCD1106 (Keratinocytes) none | 19.8 | 17.2 | 35.6 | 70.2 |
| CCD1106 (Keratinocytes) TNFalpha + IL-1beta | 1.7 | 1.3 | 13.4 | 29.3 |
| Liver cirrhosis | 0.0 | 0.5 | 0.3 | 0.0 |
| Lupus kidney | 1.8 | 2.9 | 6.2 | 8.1 |
| NCI-H292 none | 0.0 | 0.0 | 0.0 | 0.0 |
| NCI-H292 IL-4 | 0.0 | 0.0 | 0.3 | 0.4 |
| NCI-H292 IL-9 | 0.0 | 0.0 | 0.0 | 0.0 |
| NCI-H292 IL-13 | 0.0 | 0.0 | 0.0 | 0.0 |
| NCI-H292 IFN gamma | 0.0 | 0.0 | 0.0 | 0.0 |
| HPAEC none | 15.1 | 12.2 | 0.0 | 0.0 |
| HPAEC TNF alpha + IL-1 beta | 6.2 | 7.5 | 0.6 | 0.0 |
| Lung fibroblast none | 0.9 | 0.4 | 0.0 | 0.4 |
| Lung fibroblast TNF alpha + IL-1 beta | 0.6 | 0.0 | 0.0 | 0.0 |
| Lung fibroblast IL-4 | 2.1 | 2.9 | 1.7 | 3.7 |
| Lung fibroblast IL-9 | 1.2 | 0.5 | 1.2 | 2.0 |
| Lung fibroblast IL-13 | 1.2 | 0.9 | 1.6 | 3.3 |
| Lung fibroblast IFN gamma | 2.1 | 1.9 | 2.3 | 0.2 |
| Dermal fibroblast CCD1070 rest | 10.5 | 9.8 | 10.3 | 8.4 |
| Dermal fibroblast CCD1070 TNF alpha | 11.6 | 4.6 | 10.0 | 11.3 |
| Dermal fibroblast CCD1070 IL-1 beta | 4.9 | 2.2 | 4.5 | 3.8 |
| Dermal fibroblast IFN gamma | 1.2 | 1.7 | 0.3 | 1.6 |
| Dermal fibroblast IL-4 | 28.3 | 27.9 | 12.1 | 13.4 |
| IBD Colitis 2 | 0.7 | 1.6 | 0.3 | 0.0 |
| IBD Crohn's | 1.6 | 0.4 | 0.8 | 3.7 |
| Colon | 8.6 | 7.6 | 1.7 | 1.9 |
| Lung | 2.0 | 2.9 | 3.8 | 6.3 |
| Thymus | 7.0 | 13.7 | 4.1 | 4.4 |
| Kidney | 17.0 | 27.5 | 13.0 | 20.2 |

CNS_neurodegeneration_v1.0 Summary: Ag2674 While no association between expression of the SC145665404_A gene and Alzheimer's disease is apparent in this panel, the profile here confirms expression of this gene in the brain. See Panel 1.3D for discussion of potential utility of this gene in the brain.

Panel 1.3D Summary: Ag1479/2674/Ag2820 The SC145665404_A gene encodes a protein that is homologous to ten-m3 and may be involved in brain compartmentation. In multiple experiments with different probe and primer sets highest expression of this gene is seen in the brain and in brain cancer cell lines. Thus, inhibitors of this gene product could have utility in diseases involving neurite outgrowth or organization, such as neurodegenerative diseases.

In addition to expression in brain cancer cell lines, there is substantial expression in other samples derived from cancer cell lines, such as breast cancer, lung cancer, and ovarian cancer. Thus, the expression of this gene could be used to distinguish these samples from other samples in the panel. Moreover, therapeutic modulation of this gene, through the use of small molecule drugs, antibodies or protein therapeutics might be of use in the treatment of brain cancer, lung cancer, breast cancer or ovarian cancer.

This gene is also moderately expressed metabolic tissues including adrenal, thyroid, pituitary, fetal heart, adult and fetal skeletal muscle, and adipose. Thus, this gene product may be an antibody target for the treatment of any or all diseases in these tissues, including obesity and diabetes.

Panel 2D Summary: Ag2674/2820 The expression of the SC145665404_A gene was assessed in three independent runs in panel 2D using two different probe/primer sets. The highest expression of this gene is generally associated with kidney cancers. Of particular note is the consistent absence of expression in normal kidney tissue adjacent to malignant kidney. In addition, there is substantial expression associated with ovarian cancer, bladder cancer and lung cancer. Thus, the expression of this gene could be used to distinguish the above listed malignant tissue from other tissues in the panel. Particularly, the expression of this gene could be used to distinguish malignant kidney tissue from normal kidney. Moreover, therapeutic modulation of this gene, through the use of small molecule drugs, antibodies or protein therapeutics might be of benefit in the treatment of kidney cancer, ovarian cancer, bladder cancer or lung cancer.

Panel 4D Summary: Ag1479/Ag2674/Ag2820 The expression of the SC145665404_A transcript is highest in astrocytes and microvascular dermal endothelial cells (CTs=29–30), with low but significant expression in keratinocytes, and dermal fibroblasts. Expression is not modulated by any treatment, suggesting that this protein may be important in normal homeostasis. Thus, this transcript or the protein it encodes could be used to identify the tissues and cells in which it is expressed.

O. CG55910-01: ACYL-COA DESATURASE 1 (NOV10)

Expression of gene CG55910-01 was assessed using the primer-probe sets Ag2839 and Ag2031, described in Tables OA and OB. Results of the RTQ-PCR runs are shown in Tables OC, OD, OE, OF, OG and OH.

TABLE OC

CNS_neurodegeneration_v1.0

| Tissue Name | Rel. Exp. (%) Ag2839, Run 209052444 | Tissue Name | Rel. Exp. (%) Ag2839, Run 209052444 |
|---|---|---|---|
| AD 1 Hippo | 17.2 | Control (Path) 3 Temporal Ctx | 7.8 |
| AD 2 Hippo | 43.5 | Control (Path) 4 Temporal Ctx | 25.2 |
| AD 3 Hippo | 8.4 | AD 1 Occipital Ctx | 15.1 |
| AD 4 Hippo | 11.9 | AD 2 Occipital Ctx (Missing) | 0.0 |
| AD 5 hippo | 54.3 | AD 3 Occipital Ctx | 7.3 |
| AD 6 Hippo | 55.5 | AD 4 Occipital Ctx | 23.8 |
| Control 2 Hippo | 47.0 | AD 5 Occipital Ctx | 18.0 |
| Control 4 Hippo | 15.7 | AD 6 Occipital Ctx | 49.0 |
| Control (Path) 3 Hippo | 7.7 | Control 1 Occipital Ctx | 4.4 |
| AD 1 Temporal Ctx | 16.6 | Control 2 Occipital Ctx | 75.8 |
| AD 2 Temporal Ctx | 44.4 | Control 3 Occipital Ctx | 18.0 |
| AD 3 Temporal Ctx | 6.7 | Control 4 Occipital Ctx | 12.2 |
| AD 4 Temporal Ctx | 28.1 | Control (Path) 1 Occipital Ctx | 73.7 |
| AD 5 Inf Temporal Ctx | 100.0 | Control (Path) 2 Occipital Ctx | 9.9 |
| AD 5 SupTemporal Ctx | 69.7 | Control (Path) 3 Occipital Ctx | 3.7 |
| AD 6 Inf Temporal Ctx | 44.1 | Control (Path) 4 Occipital Ctx | 8.4 |
| AD 6 Sup Temporal Ctx | 43.5 | Control 1 Parietal Ctx | 11.5 |
| Control 1 Temporal Ctx | 11.7 | Control 2 Parietal Ctx | 36.1 |
| Control 2 Temporal Ctx | 53.2 | Control 3 Parietal Ctx | 21.6 |
| Control 3 Temporal Ctx | 17.3 | Control (Path) 1 Parietal Ctx | 64.6 |
| Control 4 Temporal Ctx | 14.8 | Control (Path) 2 Parietal Ctx | 23.8 |
| Control (Path) 1 Temporal Ctx | 58.6 | Control (Path) 3 Parietal Ctx | 6.5 |

TABLE OA

Probe Name Ag2839

| Primers | Sequences | Start Position | SEQ ID NO |
|---|---|---|---|
| Forward | 5'-ggcttccataattaccatcaca-3' | 1067 | 326 |
| Probe | TET-5'-cctttccctttgactactctgcgagtg-3'-TAMRA | 1089 | 327 |
| Reverse | 5'-gcacatgaaatcaatgaacca-3' | 1145 | 328 |

TABLE OB

Probe Name Ag2031

| Primers | Sequences | Start Position | SEQ ID NO |
|---|---|---|---|
| Forward | 5'-ggcttccataattaccatcaca-3' | 1067 | 329 |
| Probe | TET-5'-cctttccctttgactactctgcgagtg-3'-TAMRA | 1089 | 330 |
| Reverse | 5'-gcacatgaaatcaatgaacca-3' | 1145 | 331 |

TABLE OC-continued

| | CNS_neurodegeneration_v1.0 | | |
|---|---|---|---|
| Tissue Name | Rel. Exp. (%) Ag2839, Run 209052444 | Tissue Name | Rel. Exp. (%) Ag2839, Run 209052444 |
| Control (Path) 2 Temporal Ctx | 32.8 | Control (Path) 4 Parietal Ctx | 31.4 |

TABLE OD.

Panel 1.3D

| Tissue Name | Rel. Exp. (%) Ag2031, Run 152479705 | Rel. Exp. (%) Ag2839, Run 164023720 | Tissue Name | Rel. Exp. (%) Ag2031, Run 152479705 | Rel. Exp. (%) Ag2839, Run 164023720 |
|---|---|---|---|---|---|
| Liver adenocarcinoma | 5.2 | 7.4 | Kidney (fetal) | 2.0 | 1.6 |
| Pancreas | 5.8 | 2.1 | Renal ca. 786-0 | 0.0 | 0.0 |
| Pancreatic ca. CAPAN 2 | 0.5 | 0.3 | Renal ca. A498 | 0.4 | 0.7 |
| Adrenal gland | 12.9 | 6.9 | Renal ca. RXF 393 | 0.0 | 0.0 |
| Thyroid | 8.5 | 4.8 | Renal ca. ACHN | 0.7 | 0.4 |
| Salivary gland | 1.6 | 0.5 | Renal ca. UO-31 | 0.5 | 0.1 |
| Pituitary gland | 11.5 | 6.4 | Renal ca. TK-10 | 0.0 | 0.0 |
| Brain (fetal) | 15.3 | 9.1 | Liver | 0.3 | 0.0 |
| Brain (whole) | 45.7 | 29.7 | Liver (fetal) | 0.2 | 0.1 |
| Brain (amygdala) | 44.1 | 27.5 | Liver ca. (hepatoblast) HepG2 | 0.0 | 0.0 |
| Brain (cerebellum) | 19.5 | 30.1 | Lung | 2.7 | 2.3 |
| Brain (hippocampus) | 100.0 | 39.2 | Lung (fetal) | 2.3 | 1.1 |
| Brain (substantia nigra) | 17.8 | 10.3 | Lung ca. (small cell) LX-1 | 0.3 | 0.1 |
| Brain (thalamus) | 32.1 | 25.5 | Lung ca. (small cell) NCI-H69 | 0.9 | 0.4 |
| Cerebral Cortex | 89.5 | 100.0 | Lung ca. (s.cell var.) SHP-77 | 0.0 | 0.0 |
| Spinal cord | 39.2 | 51.1 | Lung ca. (large cell) NCI-H460 | 0.6 | 0.3 |
| glio/astro U87-MG | 1.1 | 2.6 | Lung ca. (non-sm. cell) A549 | 0.5 | 0.5 |
| glio/astro U-118-MG | 1.4 | 0.3 | Lung ca. (non-s.cell) NCI-H23 | 1.8 | 1.1 |
| astrocytoma SW1783 | 0.3 | 0.6 | Lung ca. (non-s.cell) HOP-62 | 1.0 | 0.7 |
| neuro*; met SK-N-AS | 1.4 | 0.4 | Lung ca. (non-s.cl) NCI-H522 | 1.3 | 0.8 |
| astrocytoma SF-539 | 1.2 | 1.0 | Lung ca. (squam.) SW 900 | 1.5 | 1.1 |
| astrocytoma SNB-75 | 2.7 | 0.8 | Lung ca. (squam.) NCI-H596 | 0.0 | 0.2 |
| glioma SNB-19 | 12.6 | 22.2 | Mammary gland | 1.2 | 0.9 |
| glioma U251 | 3.0 | 2.1 | Breast ca.* (pl.ef) MCF-7 | 2.1 | 4.0 |

TABLE OD.-continued

Panel 1.3D

| Tissue Name | Rel. Exp. (%) Ag2031, Run 152479705 | Rel. Exp. (%) Ag2839, Run 164023720 | Tissue Name | Rel. Exp. (%) Ag2031, Run 152479705 | Rel. Exp. (%) Ag2839, Run 164023720 |
|---|---|---|---|---|---|
| glioma SF-295 | 0.6 | 0.4 | Breast ca.* (pl.ef) MDA-MB-231 | 2.3 | 0.5 |
| Heart (fetal) | 1.6 | 1.2 | Breast ca.* (pl.ef) T47D | 0.0 | 0.0 |
| Heart | 0.6 | 1.2 | Breast ca. BT-549 | 1.3 | 0.5 |
| Skeletal muscle (fetal) | 3.4 | 4.1 | Breast ca. MDA-N | 0.0 | 0.0 |
| Skeletal muscle | 0.1 | 0.2 | Ovary | 23.3 | 30.6 |
| Bone marrow | 0.2 | 0.0 | Ovarian ca. OVCAR-3 | 8.4 | 7.4 |
| Thymus | 0.7 | 3.6 | Ovarian ca. OVCAR-4 | 2.3 | 0.9 |
| Spleen | 1.1 | 0.5 | Ovarian ca. OVCAR-5 | 1.3 | 1.0 |
| Lymph node | 0.6 | 0.2 | Ovarian ca. OVCAR-8 | 2.1 | 2.0 |
| Colorectal | 0.6 | 0.5 | Ovarian ca. IGROV-1 | 0.4 | 0.4 |
| Stomach | 2.6 | 0.8 | Ovarian ca.* (ascites) SK-OV-3 | 1.4 | 0.8 |
| Small intestine | 2.9 | 1.2 | Uterus | 1.8 | 0.5 |
| Colon ca. SW480 | 3.6 | 0.9 | Placenta | 0.7 | 0.2 |
| Colon ca.* SW620 (SW480 met) | 0.6 | 0.7 | Prostate | 1.5 | 0.5 |
| Colon ca. HT29 | 0.0 | 0.0 | Prostate ca.* (bone met) PC-3 | 0.6 | 0.5 |
| Colon ca. HCT-116 | 1.5 | 1.6 | Testis | 11.0 | 6.7 |
| Colon ca. CaCo-2 | 0.6 | 0.5 | Melanoma Hs688(A).T | 1.2 | 0.3 |
| Colon ca. tissue(ODO3866) | 0.2 | 0.5 | Melanoma* (met) Hs688(B).T | 0.8 | 0.3 |
| Colon ca. HCC-2998 | 0.1 | 0.0 | Melanoma UACC-62 | 0.2 | 0.6 |
| Gastric ca.* (liver met) NCI-N87 | 4.1 | 2.4 | Melanoma M14 | 0.2 | 0.2 |
| Bladder | 2.0 | 4.5 | Melanoma LOX IMVI | 0.2 | 0.1 |
| Trachea | 2.9 | 2.9 | Melanoma* (met) SK-MEL-5 | 1.4 | 0.5 |
| Kidney | 2.5 | 8.8 | Adipose | 0.5 | 0.4 |

TABLE OE

Panel 2D

| Tissue Name | Rel. Exp. (%) Ag2839, Run 162559077 | Tissue Name | Rel. Exp. (%) Ag2839, Run 162559077 | Tissue Name | Rel. Exp. (%) Ag2839, Run 162559077 | Tissue Name | Rel. Exp. (%) Ag2839, Run 162559077 |
|---|---|---|---|---|---|---|---|
| Normal Colon | 14.1 | Kidney Margin 8120608 | 21.2 | CC Margin (ODO3920) | 3.5 | Uterus Cancer 064011 | 12.7 |
| CC Well to Mod Diff (ODO3866) | 1.6 | Kidney Cancer 8120613 | 1.1 | CC Gr.2 ascend colon (ODO3921) | 3.6 | Normal Thyroid | 60.7 |
| CC Margin (ODO3866) | 2.2 | Kidney Margin 8120614 | 27.7 | CC Margin (ODO3921) | 2.3 | Thyroid Cancer 064010 | 34.4 |
| CC Gr.2 rectosigmoid (ODO3868) | 0.6 | Kidney Cancer 9010320 | 13.6 | CC from Partial Hepatectomy (ODO4309) Mets | 3.4 | Thyroid Cancer A302152 | 41.2 |
| CC Margin (ODO3868) | 3.0 | Kidney Margin 9010321 | 25.7 | Liver Margin (ODO4309) | 0.5 | Thyroid Margin A302153 | 35.4 |
| CC Mod Diff | 0.6 | Normal Uterus | 3.0 | | | | |

TABLE OE-continued

Panel 2D

| Tissue Name | Rel. Exp. (%) Ag2839, Run 162559077 | Tissue Name | Rel. Exp. (%) Ag2839, Run 162559077 |
|---|---|---|---|
| Colon mets to lung (OD04451-01) | 11.0 | Normal Breast | 7.3 |
| Lung Margin (OD04451-02) | 11.3 | Breast Cancer (OD04566) | 0.3 |
| Normal Prostate 6546-1 | 44.4 | Breast Cancer (OD04590-01) | 2.6 |
| Prostate Cancer (OD04410) | 10.0 | Breast Cancer Mets (OD04590-03) | 2.4 |
| Prostate Margin (OD04410) | 18.3 | Breast Cancer Metastasis (OD04655-05) | 11.6 |
| Prostate Cancer (OD04720-01) | 13.8 | Breast Cancer 064006 | 3.9 |
| Prostate Margin (OD04720-02) | 28.1 | Breast Cancer 1024 | 5.9 |
| Normal Lung 061010 | 35.1 | Breast Cancer 9100266 | 31.4 |
| Lung Met to Muscle (ODO4286) | 1.1 | Breast Margin 9100265 | 12.9 |
| Muscle Margin (ODO4286) | 2.0 | Breast Cancer A209073 | 5.8 |
| Lung Malignant Cancer (OD03126) | 6.6 | Breast Margin A2090734 | 4.1 |
| Lung Margin (OD03126) | 20.6 | Normal Liver | 1.0 |
| Lung Cancer (OD04404) | 15.6 | Liver Cancer 064003 | 0.1 |
| Lung Margin (OD04404) | 11.0 | Liver Cancer 1025 | 0.5 |
| Lung Cancer (OD04565) | 3.1 | Liver Cancer 1026 | 1.8 |
| Lung Margin (OD04565) | 4.6 | Liver Cancer 6004-T | 1.1 |
| Lung Cancer (OD04237-01) | 20.4 | Liver Tissue 6004-N | 0.4 |
| Lung Margin (OD04237-02) | 16.5 | Liver Cancer 6005-T | 0.7 |
| Ocular Mel Met to Liver (ODO4310) | 0.6 | Liver Tissue 6005-N | 0.6 |
| Liver Margin (ODO4310) | 0.5 | Normal Bladder | 42.0 |
| Melanoma Mets to | 8.1 | Bladder Cancer 1023 | 1.1 |
| Lung (OD04321) | | | |
| Lung Margin (OD04321) | 20.9 | Bladder Cancer A302173 | 37.9 |
| Normal Kidney | 87.7 | Bladder Cancer (OD04718-01) | 35.8 |
| Kidney Ca, Nuclear grade 2 (OD04338) | 3.7 | Bladder Normal Adjacent (OD04718-03) | 9.7 |
| Kidney Margin (OD04338) | 33.0 | Normal Ovary | 60.3 |
| Kidney Ca Nuclear grade 1/2 (OD04339) | 24.1 | Ovarian Cancer 064008 | 20.4 |
| Kidney Margin (OD04339) | 33.9 | Ovarian Cancer (OD04768-07) | 100.0 |
| Kidney Ca, Clear cell type (OD04340) | 7.1 | Ovary Margin (OD04768-08) | 4.4 |
| Kidney Margin (OD04340) | 52.5 | Normal Stomach | 8.2 |
| Kidney Ca, Nuclear grade 3 (OD04348) | 1.8 | Gastric Cancer 9060358 | 4.1 |
| Kidney Margin (OD04348) | 29.1 | Stomach Margin 9060359 | 10.0 |
| Kidney Cancer (OD04622-01) | 2.0 | Gastric Cancer 9060395 | 9.3 |
| Kidney Margin (OD04622-03) | 9.5 | Stomach Margin 9060394 | 4.5 |
| Kidney Cancer (OD04450-01) | 83.5 | Gastric Cancer 9060397 | 3.2 |
| Kidney Margin (OD04450-03) | 62.9 | Stomach Margin 9060396 | 1.6 |
| Kidney Cancer 8120607 | 15.3 | Gastric Cancer 064005 | 4.8 |

TABLE OF

Panel 4D

| Tissue Name | Rel. Exp. (%) Ag2031, Run 152784562 | Rel. Exp. (%) Ag2839, Run 162294682 | Tissue Name | Rel. Exp. (%) Ag2031, Run 152784562 | Rel. Exp. (%) Ag2839, Run 162294682 |
|---|---|---|---|---|---|
| Secondary Th1 act | 3.0 | 1.1 | HUVEC IL-1beta | 12.2 | 8.1 |
| Secondary Th2 act | 1.8 | 1.0 | HUVEC IFN gamma | 22.7 | 21.0 |
| Secondary Tr1 act | 2.1 | 1.2 | HUVEC TNF alpha + IFN gamma | 4.0 | 3.9 |
| Secondary Th1 rest | 0.5 | 0.2 | HUVEC TNF alpha + IL4 | 7.2 | 6.6 |
| Secondary Th2 rest | 0.2 | 0.3 | HUVEC IL-11 | 13.7 | 15.6 |
| Secondary Tr1 rest | 0.2 | 0.0 | Lung Microvascular EC none | 22.5 | 39.0 |
| Primary Th1 act | 1.6 | 1.0 | Lung Microvascular EC TNF alpha + IL-1beta | 10.8 | 9.6 |

TABLE OF-continued

Panel 4D

| Tissue Name | Rel. Exp. (%) Ag2031, Run 152784562 | Rel. Exp. (%) Ag2839, Run 162294682 | Tissue Name | Rel. Exp. (%) Ag2031, Run 152784562 | Rel. Exp. (%) Ag2839, Run 162294682 |
|---|---|---|---|---|---|
| Primary Th2 act | 0.5 | 0.5 | Microvascular Dermal EC none | 63.7 | 86.5 |
| Primary Tr1 act | 0.8 | 0.6 | Microvasular Dermal EC TNF alpha + IL-1beta | 17.9 | 19.8 |
| Primary Th1 rest | 3.1 | 2.5 | Bronchial epithelium TNF alpha + IL1beta | 2.6 | 30.8 |
| Primary Th2 rest | 0.3 | 0.6 | Small airway epithelium none | 10.4 | 9.9 |
| Primary Tr1 rest | 0.7 | 0.6 | Small airway epithelium TNF alpha + IL-1beta | 100.0 | 100.0 |
| CD45RA CD4 lymphocyte act | 5.2 | 2.5 | Coronery artery SMC rest | 14.1 | 18.2 |
| CD45RO CD4 lymphocyte act | 1.1 | 0.6 | Coronery artery SMC TNF alpha + IL-1beta | 11.7 | 6.9 |
| CD8 lymphocyte act | 1.8 | 2.1 | Astrocytes rest | 77.9 | 79.0 |
| Secondary CD8 lymphocyte rest | 0.5 | 0.7 | Astrocytes TNF alpha + IL-1beta | 61.6 | 39.0 |
| Secondary CD8 lymphocyte act | 1.6 | 2.3 | KU-812 (Basophil) rest | 0.0 | 0.0 |
| CD4 lymphocyte none | 0.1 | 0.2 | KU-812 (Basophil) PMA/ionomycin | 0.1 | 0.4 |
| 2ry Th1/Th2/Tr1_anti-CD95 CH11 | 0.3 | 0.5 | CCD1106 (Keratinocytes) none | 10.8 | 17.4 |
| LAK cells rest | 1.0 | 1.2 | CCD1106 (Keratinocytes) TNF alpha + IL-1beta | 2.0 | 14.4 |
| LAK cells IL-2 | 5.0 | 6.3 | Liver cirrhosis | 3.1 | 5.0 |
| LAK cells IL-2 + IL-12 | 0.8 | 0.9 | Lupus kidney | 3.3 | 3.4 |
| LAK cells IL-2+IFN gamma | 1.3 | 1.6 | NCI-H292 none | 40.3 | 53.6 |
| LAK cells IL-2 + IL-18 | 1.0 | 1.6 | NCI-H292 IL-4 | 75.3 | 48.0 |
| LAK cells PMA/ionomycin | 0.1 | 0.2 | NCI-H292 IL-9 | 69.3 | 68.3 |
| NK Cells IL-2 rest | 3.5 | 3.8 | NCI-H292 IL-13 | 36.3 | 31.0 |
| Two Way MLR 3 day | 1.1 | 1.4 | NCI-H292 IFN gamma | 40.6 | 28.3 |
| Two Way MLR 5 day | 1.0 | 0.5 | HPAEC none | 40.9 | 41.5 |
| Two Way MLR 7 day | 0.4 | 0.3 | HPAEC TNF alpha + IL-1beta | 15.6 | 13.5 |
| PBMC rest | 0.4 | 0.8 | Lung fibroblast none | 5.5 | 4.2 |
| PBMC PWM | 1.3 | 1.3 | Lung fibroblast TNF alpha + IL-1 beta | 2.6 | 2.2 |
| PBMC PHA-L | 2.7 | 4.1 | Lung fibroblast IL-4 | 8.6 | 9.8 |
| Ramos (B cell) none | 2.1 | 1.3 | Lung fibroblast IL-9 | 5.6 | 6.0 |
| Ramos (B cell) ionomycin | 5.6 | 11.5 | Lung fibroblast IL-13 | 4.7 | 3.7 |
| B lymphocytes PWM | 1.1 | 2.4 | Lung fibroblast IFN gamma | 8.8 | 10.0 |

TABLE OF-continued

Panel 4D

| Tissue Name | Rel. Exp. (%) Ag2031, Run 152784562 | Rel. Exp. (%) Ag2839, Run 162294682 | Tissue Name | Rel. Exp. (%) Ag2031, Run 152784562 | Rel. Exp. (%) Ag2839, Run 162294682 |
|---|---|---|---|---|---|
| B lymphocytes CD40L and IL-4 | 0.8 | 0.3 | Dermal fibroblast CCD1070 rest | 14.8 | 14.0 |
| EOL-1 dbcAMP | 9.9 | 11.3 | Dermal fibroblast CCD1070 TNF alpha | 17.6 | 19.2 |
| EOL-1 dbcAMP PMA/ionomycin | 5.0 | 4.5 | Dermal fibroblast CCD1070 IL-1 beta | 5.0 | 3.4 |
| Dendritic cells none | 0.2 | 0.1 | Dermal fibroblast IFN gamma | 9.0 | 5.2 |
| Dendritic cells LPS | 1.9 | 1.9 | Dermal fibroblast IL-4 | 28.5 | 21.0 |
| Dendritic cells anti-CD40 | 0.7 | 0.9 | IBD Colitis 2 | 0.7 | 0.9 |
| Monocytes rest | 0.6 | 0.6 | IBD Crohn's | 1.4 | 1.6 |
| Monocytes LPS | 0.1 | 0.0 | Colon | 13.3 | 9.2 |
| Macrophages rest | 0.6 | 0.4 | Lung | 18.3 | 14.2 |
| Macrophages LPS | 0.0 | 0.1 | Thymus | 89.5 | 90.1 |
| HUVEC none | 29.3 | 33.7 | Kidney | 20.3 | 24.3 |
| HUVEC starved | 59.9 | 65.1 | | | |

TABLE OG

Panel 5D

| Tissue Name | Rel. Exp. (%) Ag2839, Run 223676497 | Tissue Name | Rel. Exp. (%) Ag2839, Run 223676497 |
|---|---|---|---|
| 97457_Patient-02go_adipose | 3.6 | 94709_Donor 2 AM - A_adipose | 46.0 |
| 97476_Patient-07sk_skeletal muscle | 3.5 | 94710_Donor 2 AM - B_adipose | 22.2 |
| 97477_Patient-07ut_uterus | 3.3 | 94711_Donor 2 AM - C_adipose | 23.2 |
| 97478_Patient-07pl_placenta | 3.3 | 94712_Donor 2 AD - A_adipose | 17.9 |
| 97481_Patient-08sk_skeletal muscle | 2.6 | 94713_Donor 2 AD - B_adipose | 30.4 |
| 97482_Patient-08ut_uterus | 2.5 | 94714_Donor 2 AD - C_adipose | 13.9 |
| 97483_Patient-08pl_placenta | 2.7 | 94742_Donor 3 U - A_Mesenchymal Stem Cells | 3.7 |
| 97486_Patient-09sk_skeletal muscle | 0.8 | 94743_Donor 3 U - B_Mesenchymal Stem Cells | 2.7 |
| 97487_Patient-09ut_uterus | 2.5 | 94730_Donor 3 AM - A_adipose | 48.0 |
| 97488_Patient-09pl_placenta | 2.3 | 94731_Donor 3 AM - B_adipose | 20.4 |
| 97492_Patient-10ut_uterus | 3.7 | 94732_Donor 3 AM - C_adipose | 25.0 |
| 97493_Patient-10pl_placenta | 6.1 | 94733_Donor 3 AD - A_adipose | 21.8 |
| 97495_Patient-11go_adipose | 5.2 | 94734_Donor 3 AD - B_adipose | 11.9 |
| 97496_Patient-11sk_skeletal muscle | 1.3 | 94735_Donor AD - C_adipose | 14.8 |
| 97497_Patient-11ut_uterus | 6.7 | 77138_Liver_HepG2untreated | 0.7 |
| 97498_Patient-11pl_placenta | 4.2 | 73556_Heart_Cardiac stromal | 39.5 |
| 97500_Patient-12go_adipose | 9.8 | 81735_Small Intestine | 13.9 |
| 97501_Patient-12sk_skeletal muscle | 7.0 | 72409_Kidney_Proximal Convoluted Tubule | 2.0 |
| 97502_Patient-12ut_uterus | 12.3 | 82685_Small intestine_Duodenum | 2.1 |
| 97503_Patient-12pl_placenta | 4.0 | 90650_Adrenal_Adrenocortical adenoma | 100.0 |
| 94721_Donor 2 U - A_Mesenchymal Stem Cells | 7.5 | 72410_Kidney_HRCE | 12.7 |
| 94722_Donor 2 U - B_Mesenchymal Stem Cells | 1.1 | 72411_Kidney_HRE | 27.0 |
| 94723_Donor 2 U - C_Mesenchymal Stem Cells | 4.2 | 73139_Uterus_Uterine smooth muscle cells | 2.9 |

TABLE OH

Panel CNS_1

| Tissue Name | Rel. Exp. (%) Ag2031, Run 171620593 | Rel. Exp. (%) Ag2839, Run 171669729 | Tissue Name | Rel. Exp. (%) Ag2031, Run 171620593 | Rel. Exp. (%) Ag2839, Run 171669729 |
|---|---|---|---|---|---|
| BA4 Control | 18.8 | 27.9 | BA17 PSP | 12.0 | 14.6 |
| BA4 Control2 | 27.9 | 43.8 | BA17 PSP2 | 4.3 | 5.1 |
| BA4 Alzheimer's2 | 3.3 | 3.1 | Sub Nigra Control | 55.1 | 67.8 |
| BA4 Parkinson's | 36.1 | 40.1 | Sub Nigra Control2 | 39.5 | 47.6 |
| BA4 Parkinson's2 | 51.4 | 37.1 | Sub Nigra Alzheimer's2 | 15.2 | 24.1 |
| BA4 Huntington's | 24.1 | 24.5 | Sub Nigra Parkinson's2 | 57.8 | 79.0 |
| BA4 Huntington's2 | 3.3 | 2.5 | Sub Nigra Huntington's | 86.5 | 100.0 |
| BA4 PSP | 5.0 | 5.4 | Sub Nigra Huntington's2 | 36.6 | 38.7 |
| BA4 PSP2 | 17.1 | 21.0 | Sub Nigra PSP2 | 11.5 | 12.7 |
| BA4 Depression | 8.9 | 10.0 | Sub Nigra Depression | 5.9 | 9.3 |
| BA4 Depression2 | 6.3 | 8.7 | Sub Nigra Depression2 | 6.6 | 5.5 |
| BA7 Control | 26.6 | 28.7 | Glob Palladus Control | 20.7 | 15.2 |
| BA7 Control2 | 25.5 | 31.9 | Glob Palladus Control2 | 10.2 | 7.7 |
| BA7 Alzheimer's2 | 4.8 | 4.7 | Glob Palladus Alzheimer's | 13.5 | 20.0 |
| BA7 Parkinson's | 13.7 | 17.6 | Glob Palladus Alzheimer's2 | 4.7 | 5.5 |
| BA7 Parkinson's2 | 20.7 | 20.6 | Glob Palladus Parkinson's | 100.0 | 82.9 |
| BA7 Huntington's | 24.0 | 34.2 | Glob Palladus Parkinson's2 | 12.6 | 18.6 |
| BA7 Huntington's2 | 31.2 | 31.9 | Glob Palladus PSP | 1.7 | 3.8 |
| BA7 PSP | 15.2 | 20.9 | Glob Palladus PSP2 | 4.1 | 4.9 |
| BA7 PSP2 | 13.0 | 18.4 | Glob Palladus Depression | 4.2 | 4.3 |
| BA7 Depression | 6.7 | 6.4 | Temp Pole Control | 8.4 | 9.6 |
| BA9 Control | 17.6 | 15.1 | Temp Pole Control2 | 32.1 | 43.8 |
| BA9 Control2 | 51.4 | 75.8 | Temp Pole Alzheimer's | 2.1 | 4.2 |
| BA9 Alzheimer's | 2.2 | 2.8 | Temp Pole Alzheimer's2 | 2.7 | 4.6 |
| BA9 Alzheimer's2 | 6.8 | 7.1 | Temp Pole Parkinson's | 20.9 | 22.5 |
| BA9 Parkinson's | 17.8 | 20.4 | Temp Pole Parkinson's2 | 18.4 | 23.3 |
| BA9 Parkinson's2 | 40.3 | 31.9 | Temp Pole Huntington's | 32.3 | 37.6 |
| BA9 Huntington's | 29.3 | 38.4 | Temp Pole PSP | 3.5 | 2.1 |
| BA9 Huntington's2 | 8.3 | 8.0 | Temp Pole PSP2 | 1.9 | 2.8 |
| BA9 PSP | 8.7 | 8.2 | Temp Pole Depression2 | 4.2 | 5.4 |
| BA9 PSP2 | 3.4 | 1.9 | Cing Gyr Control | 42.3 | 64.6 |
| BA9 Depression | 4.7 | 4.4 | Cing Gyr Control2 | 26.8 | 27.0 |
| BA9 Depression2 | 3.8 | 4.8 | Cing Gyr Alzheimer's | 13.0 | 20.0 |
| BA17 Control | 27.7 | 32.1 | Cing Gyr Alzheimer's2 | 3.3 | 5.2 |
| BA17 Control2 | 28.1 | 33.2 | Cing Gyr Parkinson's | 34.6 | 37.9 |
| BA17 Alzheimer's2 | 2.8 | 3.1 | Cing Gyr Parkinson's2 | 30.6 | 34.6 |
| BA17 Parkinson's | 27.2 | 30.1 | Cing Gyr Huntington's | 50.7 | 66.0 |
| BA17 | 25.2 | 22.1 | Cing Gyr | 26.2 | 33.0 |

TABLE OH-continued

Panel CNS_1

| Tissue Name | Rel. Exp. (%) Ag2031, Run 171620593 | Rel. Exp. (%) Ag2839, Run 171669729 | Tissue Name | Rel. Exp. (%) Ag2031, Run 171620593 | Rel. Exp. (%) Ag2839, Run 171669729 |
|---|---|---|---|---|---|
| Parkinson's2 BA17 | 15.3 | 18.8 | Huntington's2 Cing Gyr PSP | 12.2 | 17.4 |
| Huntington's BA17 | 7.4 | 10.5 | Cing Gyr PSP2 | 5.4 | 6.8 |
| Huntington's2 BA17 | 9.2 | 7.7 | Cing Gyr Depression | 5.4 | 8.6 |
| Depression BA17 Depression2 | 15.4 | 15.1 | Cing Gyr Depression2 | 11.0 | 10.2 |

CNS_neurodegeneration_v1.0 Summary: Ag2839 While no association between the CG55910-01 gene and Alzheimer's disease is evident from the results of this panel, this experiment confirms expression of this gene in the brain. See Panel 1.3D for discussion of utility of this gene in the central nervous system.

Panel 1.3D Summary: Ag2031/2839 Brain-specific expression of the CG55910-01 gene suggests a role for this gene in CNS processes. Polyunsaturated fatty acids (PU-FAs), specifically the n-3 and n-6 series, play a key role in the progression or prevention of human diseases such as obesity, diabetes, cancer, and neurological and heart disease. They function mainly by affecting cellular membrane lipid composition, metabolism, signal-transduction pathways, and by direct control of gene expression. Therefore, modulators of this gene product may have utility in treating neurological diseases, such as Alzheimer's disease.

This gene is also moderately expressed in a variety of metabolic tissues including pancreas, adrenal, thyroid, pituitary, adult and fetal heart, and adipose. This gene product appears to be differentially expressed in fetal (CT value=30–32) vs adult skeletal muscle (CT value=34) and may be useful for the identification of the adult vs fetal source of this tissue. This gene encodes a fatty acid desaturase homolog. Fatty acid desaturases are on the metabolic pathway to triglyceride deposition. Thus, small molecule inhibition of this gene product may prevent the formation of fat and be effective in the treatment for obesity.

Panel 2D Summary: Ag2839 The expression of the CG55910-01 gene appears to be highest in a sample derived from an ovarian cancer (CT=27.8). Of note is the difference in expression between this ovarian cancer and its normal adjacent tissue. There is also expression in a number of ovarian cancer samples in this panel. Thus, the expression of this gene could be used to distinguish this ovarian cancer from its normal adjacent tissue. Moreover, therapeutic modulation of this gene, through the use of small molecule drugs, antibodies or protein therapeutics might be of benefit in the treatment of ovarian cancer.

Panel 4D Summary: Ag2031/2839 The CG55910-01 transcript is highly expressed in TNFalpha and II-1beta stimulated small airway epithelium, normal thymus, dermal fibroblasts, and NCI-H292 cells but not in leukocytes. This expression pattern is consistent with both sets of primers and probes. The expression profile suggests that the protein encoded by this transcript could potentially regulate T cell development in the thymus and the response of small airway epithelium to proinflammatory cytokines. Thus, therapeutics designed with the protein encoded by this transcript could be important in immune modulation and in the treatment of lung diseases such as asthma and COPD.

Panel 5D Summary: Ag2839 Expression of the CG55910-01 gene is mainly restricted to adipose. This gene encodes an acetyl coA desaturase. Fatty acid desaturases are on the metabolic pathway to triglyceride deposition. Thus, small molecule inhibition of this gene product may prevent the formation of fat and be effective in the treatment for obesity. Thus, therapeutic modulation of the expression or function of this gene may be effective in the treatment of obesity.

Panel CNS_1 Summary: Ag2839 While no association between the CG55910-01 gene and any disease is evident from the results of this panel, this experiment confirms expression of this gene in the brain. See Panel 1.3D for discussion of utility of this gene in the central nervous system.

P. CG50281-01: 34 Wnt 10B Like (NOV11)

Expression of gene CG50281-01 was assessed using the primer-probe set Ag2538, described in Table PA. Results of the RTQ-PCR runs are shown in Tables PB, PC, PD, PE and PF.

TABLE PA

Probe Name Ag2538

| Primers | Sequences | Start Position | SEQ ID NO |
|---|---|---|---|
| Forward | 5'-acaacgccttgactcttcttct-3' | 115 | 332 |
| Probe | TET-5'-aagacctccaagcctcagggactctg-3'-TAMRA | 139 | 333 |
| Reverse | 5'-acaagaagaaacaccccttgat-3' | 168 | 334 |

TABLE PB

CNS_neurodegeneration_v1.0

| Tissue Name | Rel. Exp. (%) Ag2538, Run 208779569 | Tissue Name | Rel. Exp. (%) Ag2538, Run 208779569 | Tissue Name | Rel. Exp. (%) Ag2538, Run 208779569 | Tissue Name | Rel. Exp. (%) Ag2538, Run 208779569 |
|---|---|---|---|---|---|---|---|
| AD 1 Hippo | 19.6 | Control (Path) 3 Temporal Ctx | 5.2 | AD 5 Inf Temporal Ctx | 43.5 | Control (Path) 2 Occipital Ctx | 2.6 |
| AD 2 Hippo | 35.4 | Control (Path) 4 Temporal Ctx | 24.7 | AD 5 Sup Temporal Ctx | 58.2 | Control (Path) 3 Occipital Ctx | 2.8 |
| AD 3 Hippo | 1.6 | AD 1 Occipital Ctx | 6.8 | AD 6 Inf Temporal Ctx | 58.2 | Control (Path) 4 Occipital Ctx | 28.3 |
| AD 4 Hippo | 0.0 | AD 2 Occipital Ctx (Missing) | 0.0 | AD 6 Sup Temporal Ctx | 68.8 | Control 1 Parietal Ctx | 4.4 |
| AD 5 Hippo | 4.0 | AD 3 Occipital Ctx | 7.6 | Control 1 Temporal Ctx | 5.8 | Control 2 Parietal Ctx | 59.9 |
| AD 6 Hippo | 19.1 | AD 4 Occipital Ctx | 29.5 | Control 2 Temporal Ctx | 41.2 | Control 3 Parietal Ctx | 9.0 |
| Control 2 Hippo | 54.3 | AD 5 Occipital Ctx | 12.6 | Control 3 Temporal Ctx | 18.3 | Control (Path) 1 Parietal Ctx | 100.0 |
| Control 4 Hippo | 5.2 | AD 6 Occipital Ctx | 7.6 | Control 3 Temporal Ctx | 21.5 | Control (Path) 2 Parietal Ctx | 40.1 |
| Control (Path) 3 Hippo | 0.0 | Control 1 Occipital Ctx | 0.0 | Control (Path) 1 Temporal Ctx | 83.5 | Control (Path) 3 Parietal Ctx | 0.0 |
| AD 1 Temporal Ctx | 19.5 | Control 2 Occipital Ctx | 49.3 | Control (Path) 2 Temporal Ctx | 58.6 | Control (Path) 4 Parietal Ctx | 14.4 |
| AD 2 Temporal Ctx | 38.2 | Control 3 Occipital Ctx | 7.6 | | | | |
| AD 3 Temporal Ctx | 6.7 | Control 4 Occipital Ctx | 0.0 | | | | |
| AD 4 Temporal Ctx | 4.2 | Control (Path) 1 Occipital Ctx | 61.1 | | | | |

TABLE PC

Panel 1.3D

| Tissue Name | Rel. Exp. (%) Ag2538, Run 162187100 | Rel. Exp. (%) Ag2538, Run 165639905 | Tissue Name | Rel. Exp. (%) Ag2538, Run 162187100 | Rel. Exp. (%) Ag2538, Run 165639905 |
|---|---|---|---|---|---|
| Liver adenocarcinoma | 0.0 | 0.0 | Kidney (fetal) | 0.0 | 0.0 |
| Pancreas | 0.0 | 0.0 | Renal ca. 786-0 | 0.0 | 0.0 |
| Pancreatic ca. CAPAN 2 | 0.0 | 0.0 | Renal ca. A498 | 0.0 | 0.0 |
| Adrenal gland | 0.0 | 0.0 | Renal ca. RXF 393 | 10.2 | 42.3 |
| Thyroid | 0.0 | 0.0 | Renal ca. ACHN | 0.0 | 0.0 |
| Salivary gland | 0.0 | 0.0 | Renal ca. UO-31 | 0.0 | 0.0 |
| Pituitary gland | 0.0 | 0.0 | Renal ca. TK-10 | 0.0 | 3.1 |
| Brain (fetal) | 18.0 | 46.7 | Liver | 0.0 | 0.0 |
| Brain (whole) | 11.3 | 0.0 | Liver (fetal) | 0.0 | 0.0 |
| Brain (amygdala) | 22.2 | 59.9 | Liver ca. (hepatoblast) HepG2 | 0.0 | 0.0 |
| Brain (cerebellum) | 0.0 | 0.0 | Lung | 0.0 | 0.0 |
| Brain (hippocampus) | 31.6 | 66.9 | Lung (fetal) | 0.0 | 0.0 |
| Brain (substantia nigra) | 0.0 | 0.0 | Lung ca. (small cell) LX-1 | 0.0 | 0.0 |
| Brain (thalamus) | 0.0 | 10.5 | Lung ca. | 0.0 | 0.0 |

TABLE PC-continued

Panel 1.3D

| Tissue Name | Rel. Exp. (%) Ag2538, Run 162187100 | Rel. Exp. (%) Ag2538, Run 165639905 | Tissue Name | Rel. Exp. (%) Ag2538, Run 162187100 | Rel. Exp. (%) Ag2538, Run 165639905 |
|---|---|---|---|---|---|
| Cerebral Cortex | 100.0 | 5.7 | (small cell) NCI-H69 Lung ca. (s.cell var.) SHP-77 | 0.0 | 0.0 |
| Spinal cord | 0.0 | 0.0 | Lung ca. (large cell)NCI-H460 | 0.0 | 58.6 |
| glio/astro U87-MG | 0.0 | 0.0 | Lung ca. (non-sm. cell) A549 | 0.0 | 0.0 |
| glio/astro U-118-MG | 0.0 | 0.0 | Lung ca. (non-s.cell) NCI-H23 | 8.7 | 0.0 |
| astrocytoma SW1783 | 0.0 | 0.0 | Lung ca. (non-s.cell) HOP-62 | 0.0 | 0.0 |
| neuro*; met SK-N-AS | 7.7 | 0.0 | Lung ca. (non-s.cl) NCI-H522 | 0.0 | 0.0 |
| astrocytoma SF-539 | 0.0 | 0.0 | Lung ca. (squam.) SW 900 | 0.0 | 0.0 |
| astrocytoma SNB-75 | 0.0 | 0.0 | Lung ca. (squam.) NCI-H596 | 0.0 | 0.0 |
| glioma SNB-19 | 6.8 | 0.0 | Mammary gland | 0.0 | 0.0 |
| glioma U251 | 0.0 | 0.0 | Breast ca.* (pl.ef) MCF-7 | 7.2 | 0.0 |
| glioma SF-295 | 0.0 | 0.0 | Breast ca.* (pl.ef) MDA-MB-231 | 0.0 | 0.0 |
| Heart (fetal) | 0.0 | 0.0 | Breast ca.* (pl.ef) T47D | 7.5 | 0.0 |
| Heart | 0.0 | 0.0 | Breast ca. BT-549 | 0.0 | 15.6 |
| Skeletal muscle (fetal) | 4.5 | 0.0 | Breast ca. MDA-N | 0.0 | 0.0 |
| Skeletal muscle | 0.0 | 0.0 | Ovary | 0.0 | 0.0 |
| Bone marrow | 0.0 | 0.0 | Ovarian ca. OVCAR-3 | 0.0 | 0.0 |
| Thymus | 0.0 | 0.0 | Ovarian ca. OVCAR-4 | 0.0 | 0.0 |
| Spleen | 0.0 | 0.0 | Ovarian ca. OVCAR-5 | 0.0 | 0.0 |
| Lymph node | 0.0 | 11.1 | Ovarian ca. OVCAR-8 | 0.0 | 0.0 |
| Colorectal | 0.0 | 10.4 | Ovarian ca. IGROV-1 | 0.0 | 0.0 |
| Stomach | 0.0 | 0.0 | Ovarian ca.* (ascites) SK-OV-3 | 0.0 | 0.0 |
| Small intestine | 8.9 | 100.0 | Uterus | 0.0 | 0.0 |
| Colon ca. SW480 | 0.0 | 0.0 | Placenta | 0.0 | 0.0 |
| Colon ca.* SW620 (SW480 met) | 0.0 | 0.0 | Prostate | 0.0 | 0.0 |
| Colon ca. HT29 | 0.0 | 0.0 | Prostate ca.* (bone met) PC-3 | 0.0 | 0.0 |
| Colon ca. HCT-116 | 18.4 | 0.0 | Testis | 38.4 | 0.0 |
| Colon ca. CaCo-2 | 10.6 | 0.0 | Melanoma Hs688(A).T | 0.0 | 0.0 |
| Colon ca. tissue (ODO3866) | 0.0 | 0.0 | Melanoma* (met) Hs668(B).T | 0.0 | 0.0 |
| Colon ca. HCC-2998 | 14.5 | 0.0 | Melanoma UACC-62 | 9.2 | 0.0 |
| Gastric ca.* (liver met) NCI-N87 | 0.0 | 0.0 | Melanoma M14 | 8.4 | 0.0 |
| Bladder | 23.3 | 15.0 | Melanoma LOX IMVI | 5.3 | 0.0 |

TABLE PC-continued

Panel 1.3D

| Tissue Name | Rel. Exp. (%) Ag2538, Run 162187100 | Rel. Exp. (%) Ag2538, Run 165639905 | Tissue Name | Rel. Exp. (%) Ag2538, Run 162187100 | Rel. Exp. (%) Ag2538, Run 165639905 |
|---|---|---|---|---|---|
| Trachea | 0.0 | 0.0 | Melanoma* (met) SK-MEL-5 | 0.0 | 51.4 |
| Kidney | 0.0 | 0.0 | Adipose | 0.0 | 0.0 |

TABLE PD

Panel 2D

| Tissue Name | Rel. Exp. (%) Ag2538, Run 161920580 | Tissue Name | Rel. Exp. (%) Ag2538, Run 161920580 |
|---|---|---|---|
| Normal Colon | 9.7 | Kidney Margin 8120608 | 2.9 |
| CC Well to Mod Diff (ODO3866) | 0.0 | Kidney Cancer 8120613 | 0.0 |
| CC Margin (ODO3866) | 9.8 | Kidney Margin 8120614 | 0.0 |
| CC Gr.2 rectosigmoid (ODO3868) | 6.0 | Kidney Cancer 9010320 | 0.0 |
| CC Margin (ODO3868) | 0.0 | Kidney Margin 9010321 | 0.0 |
| CC Mod Diff (ODO3920) | 0.0 | Normal Uterus | 0.0 |
| CC Margin (ODO3920) | 0.0 | Uterus Cancer 064011 | 0.0 |
| CC Gr.2 ascend colon (ODO3921) | 0.0 | Normal Thyroid | 0.0 |
| CC Margin (ODO3921) | 21.8 | Thyroid Cancer 064010 | 0.0 |
| CC from Partial Hepatectomy (ODO4309) Mets | 0.0 | Thyroid Cancer A302152 | 8.4 |
| Liver Margin (ODO4309) | 0.0 | Thyroid Margin A302153 | 0.0 |
| Colon mets to lung (OD04451-01) | 0.0 | Normal Breast | 0.0 |
| Lung Margin (OD04451-02) | 0.0 | Breast Cancer (OD04566) | 0.0 |
| Normal Prostate 6546-1 | 0.0 | Breast Cancer (OD04590-01) | 8.0 |
| Prostate Cancer (OD04410) | 10.1 | Breast Cancer Mets (OD04590-03) | 0.0 |
| Prostate Margin (OD04410) | 0.0 | Breast Cancer Metastasis (OD04655-05) | 0.0 |
| Prostate Cancer (OD04720-01) | 0.0 | Breast Cancer 064006 | 0.0 |
| Prostate Margin (OD04720-02) | 0.0 | Breast Cancer 1024 | 0.0 |
| Normal Lung 061010 | 10.4 | Breast Cancer 9100266 | 0.0 |
| Lung Met to Muscle (ODO4286) | 0.0 | Breast Margin 9100265 | 0.0 |
| Muscle Margin (ODO4286) | 0.0 | Breast Cancer A209073 | 0.0 |
| Lung Malignant Cancer (OD03126) | 0.0 | Breast Margin A2090734 | 8.5 |
| Lung Margin (OD03126) | 0.0 | Normal Liver | 0.0 |
| Lung Cancer (OD04404) | 0.0 | Liver Cancer 064003 | 0.0 |
| Lung Margin (OD04404) | 0.0 | Liver Cancer 1025 | 0.0 |
| Lung Cancer (OD04565) | 0.0 | Liver Cancer 1026 | 0.0 |
| Lung Margin (OD04565) | 0.0 | Liver Cancer 6004-T | 0.0 |
| Lung Cancer (OD04237-01) | 0.0 | Liver Tissue 6004-N | 13.5 |
| Lung Margin (OD04237-02) | 0.0 | Liver Cancer 6005-T | 0.0 |
| Ocular Mel Met to Liver (ODO4310) | 0.0 | Liver Tissue 6005-N | 0.0 |
| Liver Margin (ODO4310) | 0.0 | Normal Bladder | 0.0 |
| Melanoma Mets to Lung (OD04321) | 0.0 | Bladder Cancer 1023 | 0.0 |
| Lung Margin (OD04321) | 0.0 | Bladder Cancer A302173 | 100.0 |
| Normal Kidney | 7.3 | Bladder Cancer (OD04718-01) | 46.3 |
| Kidney Ca, Nuclear grade 2 (OD04338) | 0.0 | Bladder Normal Adjacent (OD04718-03) | 0.0 |
| Kidney Margin (OD04338) | 8.4 | Normal Ovary | 0.0 |
| Kidney Ca Nuclear grade 1/2 (OD04339) | 8.3 | Ovarian Cancer 064008 | 0.0 |
| Kidney Margin (OD04339) | 0.0 | Ovarian Cancer (OD04768-07) | 6.2 |
| Kidney Ca, Clear cell type (OD04340) | 0.0 | Ovary Margin (OD04768-08) | 0.0 |
| Kidney Margin (OD04340) | 0.0 | Normal Stomach | 0.0 |
| Kidney Ca, Nuclear grade 3 (OD04348) | 0.0 | Gastric Cancer 9060358 | 0.0 |
| Kidney Margin (OD04348) | 0.0 | Stomach Margin 9060359 | 0.0 |
| Kidney Cancer (OD04622-01) | 0.0 | Gastric Cancer 9060395 | 0.0 |
| Kidney Margin (OD04622-03) | 0.0 | Stomach Margin 9060394 | 6.7 |
| Kidney Cancer (OD04450-01) | 0.0 | Gastric Cancer 9060397 | 0.0 |
| Kidney Margin (OD04450-03) | 0.0 | Stomach Margin 9060396 | 0.0 |
| Kidney Cancer 8120607 | 0.0 | Gastric Cancer 064005 | 0.0 |

TABLE PE

Panel 3D

| Tissue Name | Rel. Exp. (%) Ag2538, Run 164843785 | Tissue Name | Rel. Exp. (%) Ag2538, Run 164843785 |
|---|---|---|---|
| Daoy-Medulloblastoma | 0.0 | Ca Ski-Cervical epidermoid carcinoma (metastasis) | 0.0 |
| TE671-Medulloblastoma | 0.0 | ES-2-Ovarian clear cell carcinoma | 0.0 |
| D283 Med-Medulloblastoma | 6.1 | Ramos-Stimulated with PMA/ionomycin 6 h | 0.0 |
| PFSK-1-Primitive Neuroectodermal | 18.8 | Ramos-Stimulated with PMA/ionomycin 14 h | 0.0 |
| XF-498-CNS | 0.0 | MEG-01-Chronic myelogenous leukemia (megokaryoblast) | 0.0 |
| SNB-78-Glioma | 0.0 | Raji-Burkitt's lymphoma | 0.0 |
| SF-268-Glioblastoma | 7.2 | Daudi-Burkitt's lymphoma | 0.0 |
| T98G-Glioblastoma | 0.0 | U266-B-cell plasmacytoma | 8.2 |
| SK-N-SH-Neuroblastoma (metastasis) | 0.0 | CA46-Burkitt's lymphoma | 0.0 |
| SF-295-Glioblastoma | 0.0 | RL-non-Hodgkin's B-cell lymphoma | 0.0 |
| Cerebellum | 0.0 | JM1-pre-B-cell lymphoma | 0.0 |
| Cerebellum | 0.0 | Jurkat-T cell leukemia | 0.0 |
| NCI-H292-Mucoepidermoid lung carcinoma | 0.0 | TF-1-Erythroleukemia | 0.0 |
| DMS-114-Small cell lung cancer | 3.7 | HUT 78-T-Cell lymphoma | 0.0 |
| DMS-79-Small cell lung cancer | 0.0 | U937-Histiocytic lymphoma | 0.0 |
| NCI-H146-Small cell lung cancer | 0.0 | KU-812-Myelogenous leukemia | 0.0 |
| NCI-H526-Small cell lung cancer | 0.0 | 769-P-Clear cell renal carcinoma | 0.0 |
| NCI-N417-Small cell lung cancer | 100.0 | Caki-2-Clear cell renal carcinoma | 0.0 |
| NCI-H82-Small cell lung cancer | 2.3 | SW 839-Clear cell renal carcinoma | 0.0 |
| NCI-H157-Squamous cell lung cancer (metastasis) | 0.0 | G401-Wilms' tumor | 0.0 |
| NCI-H1155-Large cell lung cancer | 0.0 | Hs766T-Pancreatic carcinoma (LN metastasis) | 0.0 |
| NCI-H1299-Large cell lung cancer | 0.0 | CAPAN-1-Pancreatic adenocarcinoma (liver metastasis) | 0.0 |
| NCI-H727-Lung carcinoid | 0.0 | SU86.86-Pancreatic carcinoma (liver metastasis) | 0.0 |
| NCI-UMC-11-Lung carcinoid | 0.0 | BxPC-3-Pancreatic adenocarcinoma | 0.0 |
| LX-1-Small cell lung cancer | 0.0 | HPAC-Pancreatic adenocarcinoma | 0.0 |
| Colo-205-Colon cancer | 0.0 | MIA PaCa-2-Pancreatic carcinoma | 0.0 |
| KM12-Colon cancer | 0.0 | CFPAC-1-Pancreatic ductal adenocarcinoma | 0.0 |
| KM20L2-Colon cancer | 0.0 | PANC-1-Pancreatic epithelioid ductal carcinoma | 0.0 |
| NCI-H716-Colon cancer | 0.0 | T24-Bladder carcinma (transitional cell) | 0.0 |
| SW-48-Colon adenocarcinoma | 0.0 | 5637-Bladder carcinoma | 0.0 |
| SW1116-Colon adenocarcinoma | 7.2 | HT-1197-Bladder carcinoma | 0.0 |
| LS 174T-Colon adenocarcinoma | 0.0 | UM-UC-3-Bladder carcinma (transitional cell) | 0.0 |
| SW-948-Colon adenocarcinoma | 0.0 | A204-Rhabdomyo-sarcoma | 0.0 |
| SW-480-Colon adenocarcinoma | 0.0 | HT-1080-Fibro-sarcoma | 0.0 |
| NCI-SNU-5-Gastric carcinoma | 0.0 | MG-63-Osteosarcoma | 0.0 |
| KATO III-Gastric carcinoma | 0.0 | SK-LMS-1-Leiomyo-sarcoma (vulva) | 0.0 |
| NCI-SNU-16-Gastric carcinoma | 0.0 | SJRH30-Rhabdomyo-sarcoma (met to bone marrow) | 0.0 |
| NCI-SNU-1-Gastric carcinoma | 0.0 | A431-Epidermoid carcinoma | 0.0 |
| RF-1-Gastric adenocarcinoma | 0.0 | WM266-4-Melanoma | 5.0 |
| RF-48-Gastric adenocarcinoma | 0.0 | DU 145-Prostate carcinoma (brain metastasis) | 0.0 |
| MKN-45-Gastric carcinoma | 0.0 | MDA-MB-468-Breast adenocarcinoma | 0.0 |
| NCI-N87-Gastric carcinoma | 0.0 | SCC-4-Squamous cell carcinoma of tongue | 0.0 |
| OVCAR-5-Ovarian carcinoma | 0.0 | SCC-9-Squamous cell carcinoma of tongue | 0.0 |
| RL95-2-Uterine carcinoma | 0.0 | SCC-15-Squamous cell carcinoma of tongue | 0.0 |
| HelaS3-Cervical adenocarcinoma | 0.0 | CAL 27-Squamous cell carcinoma of tongue | 12.3 |

TABLE PF

Panel 4D

| Tissue Name | Rel. Exp. (%) Ag2538, Run 164034950 | Tissue Name | Rel. Exp. (%) Ag2538, Run 164034950 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 6.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 6.2 | Microvascular Dermal EC none | 0.0 |
| Primary Tr1 act | 6.7 | Microsvascular Dermal EC TNFalpha + IL-1beta | 0.0 |
| Primary Th1 rest | 0.0 | Bronchial epithelium TNFalpha + IL1beta | 0.0 |
| Primary Th2 rest | 0.0 | Small airway epithelium none | 0.0 |
| Primary Tr1 rest | 4.2 | Small airway | 0.0 |

TABLE PF-continued

Panel 4D

| Tissue Name | Rel. Exp. (%) Ag2538, Run 164034950 | Tissue Name | Rel. Exp. (%) Ag2538, Run 164034950 |
|---|---|---|---|
| | | epithelium TNFalpha + IL-1beta | |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 0.0 |
| Secondary CD8 lymphocyte act | 6.9 | KU-812 (Basophil) rest | 0.0 |
| CD4 lymphocyte none | 6.6 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 3.5 | CCD1106 (Keratinocytes) TNFalpha + IL-1beta | 0.0 |
| LAK cells IL-2 | 7.6 | Liver cirrhosis | 19.2 |
| LAK cells IL-2+IL-12 | 0.0 | Lupus kidney | 0.0 |
| LAK cells IL-2+IFN gamma | 0.0 | NCI-H292 none | 0.0 |
| LAK cells IL-2+ IL-18 | 0.0 | NCI-H292 IL-4 | 0.0 |
| LAK cells PMA/ionomycin | 8.4 | NCI-H292 IL-9 | 9.6 |
| NK Cells IL-2 rest | 3.1 | NCI-H292 IL-13 | 7.1 |
| Two Way MLR 3 day | 8.5 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 0.0 | Lung fibroblast none | 0.0 |
| PBMC PWM | 0.0 | Lung fibroblast TNF alpha + IL-1 beta | 0.0 |
| PBMC PHA-L | 0.0 | Lung fibroblast IL-4 | 0.0 |
| Ramos (B cell) none | 4.2 | Lung fibroblast IL-9 | 0.0 |
| Ramos (B cell) ionomycin | 11.7 | Lung fibroblast IL-13 | 0.0 |
| B lymphocytes PWM | 3.8 | Lung fibroblast IFN gamma | 0.0 |
| B lymphocytes CD40L and IL-4 | 0.0 | Dermal fibroblast CCD1070 rest | 0.0 |
| EOL-1 dbcAMP | 11.5 | Dermal fibroblast CCD1070 TNF alpha | 10.6 |
| EOL-1 dbcAMP PMA/ionomycin | 60.3 | Dermal fibroblast CCD1070 IL-1 beta | 0.0 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 7.9 |
| Monocytes rest | 0.0 | IBD Crohn's | 7.1 |
| Monocytes LPS | 0.0 | Colon | 100.0 |
| Macrophages rest | 1.4 | Lung | 27.7 |
| Macrophages LPS | 4.7 | Thymus | 0.0 |
| HUVEC none | 0.0 | Kidney | 0.0 |
| HUVEC starved | 0.0 | | |

CNS_neurodegeneration_v1.0 Summary: Ag2538 While no association between expression of the CG50281-01 gene and Alzheimer's disease is apparent in this panel, the profile here confirms expression of this gene in the brain. See Panel 1.3D for discussion of potential utility of this gene in the brain.

Panel 1.3D Summary: Ag2538 This gene encodes a Wnt 10b homolog, with low but significant expression in the brain in two experiments with the same probe and primer set. Wnt 10b is downstream of sonic hedgehog in follicular development. Sonic hedgehog regulates hair growth and when expressed in follicles can induce new hair growth. Therefore, expression of this gene by gene therapy may have therapeutic utility in the treatment of hair loss.

The wnt pathway has also been implicated in Alzheimer's disease. Agents that potentiate the signaling of this gene product may thus have utility in the treatment of neurodegenerative diseases such as Alzheimer's disease.

In addition, expression of this gene is extremely low in the cancer cell lines on this panel, suggesting that a decrease in expression correlates to cell proliferation.

Panel 2D Summary: Ag2538 The expression of the CG50281-01 gene is significantly increased in bladder cancer compared to normal bladder samples. These data indicate that the expression of this gene might be associated with bladder cancer and may be used as a diagnostic marker of disease. Thus, therapeutic modulation of the gene product by antibodies, small molecule inhibitors and chimeric molecules might be of use in the treatment of bladder cancer.

Panel 3D Summary: Ag2538 Expression of the CG50281-01 gene is limited to few cell lines on this panel including a lung cancer cell line and a cell line derived from squamous carcinoma of the tongue. Thus, expression of this gene could be used to differentiate these samples from other samples on this panel.

Example 3

SNP Analysis of NOVX Clones

SeqCalling™ Technology: cDNA was derived from various human samples representing multiple tissue types, normal and diseased states, physiological states, and developmental states from different donors. Samples were obtained as whole tissue, cell lines, primary cells or tissue cultured primary cells and cell lines. Cells and cell lines may have been treated with biological or chemical agents that regulate gene expression for example, growth factors, chemokines, steroids. The cDNA thus derived was then sequenced using CuraGen's proprietary SeqCalling technology. Sequence traces were evaluated manually and edited for corrections if appropriate. cDNA sequences from all samples were assembled with themselves and with public ESTs using bioinformatics programs to generate CuraGen's human SeqCalling database of SeqCalling assemblies. Each assembly contains one or more overlapping cDNA sequences derived from one or more human samples. Fragments and ESTs were included as components for an assembly when the extent of identity with another component of the assembly was at least 95% over 50 bp. Each assembly can represent a gene and/or its variants such as splice forms and/or single nucleotide polymorphisms (SNPs) and their combinations.

Variant sequences are included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, however, in the case that a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern for example, alteration in temporal expression, physiological response regulation, cell type expression regulation, intensity of expression, stability of transcribed message.

Method of novel SNP Identification: SNPs are identified by analyzing sequence assemblies using CuraGen's proprietary SNPTool algorithm. SNPTool identifies variation in assemblies with the following criteria: SNPs are not analyzed within 10 base pairs on both ends of an alignment; Window size (number of bases in a view) is 10; The allowed number of mismatches in a window is 2; Minimum SNP base quality (PHRED score) is 23; Minimum number of changes to score an SNP is 2/assembly position. SNPTool analyzes the assembly and displays SNP positions, associated individual variant sequences in the assembly, the depth of the assembly at that given position, the putative assembly allele frequency, and the SNP sequence variation. Sequence traces are then selected and brought into view for manual validation. The consensus assembly sequence is imported into CuraTools along with variant sequence changes to identify potential amino acid changes resulting from the SNP sequence variation. Comprehensive SNP data analysis is then exported into the SNPCalling database.

Method of novel SNP Confirmation: SNPs are confirmed employing a validated method know as Pyrosequencing (Pyrosequencing, Westborough, Mass.). Detailed protocols for Pyrosequencing can be found in: Alderborn et al. Determination of Single Nucleotide Polymorphisms by Real-time Pyrophosphate DNA Sequencing. (2000). *Genome Research*. 10, Issue 8, August. 1249–1265. In brief, Pyrosequencing is a real time primer extension process of genotyping. This protocol takes double-stranded, biotinylated PCR products from genomic DNA samples and binds them to streptavidin beads. These beads are then denatured producing single stranded bound DNA. SNPs are characterized utilizing a technique based on an indirect bioluminometric assay of pyrophosphate (PPi) that is released from each dNTP upon DNA chain elongation. Following Klenow polymerase-mediated base incorporation, PPi is released and used as a substrate, together with adenosine 5'-phosphosulfate (APS), for ATP sulfurylase, which results in the formation of ATP. Subsequently, the ATP accomplishes the conversion of luciferin to its oxi-derivative by the action of luciferase. The ensuing light output becomes proportional to the number of added bases, up to about four bases. To allow processivity of the method dNTP excess is degraded by apyrase, which is also present in the starting reaction mixture, so that only dNTPs are added to the template during the sequencing. The process has been fully automated and adapted to a 96-well format, which allows rapid screening of large SNP panels. The DNA and protein sequences for the novel single nucleotide polymorphic variants are reported. Variants are reported individually but any combination of all or a select subset of variants are also included. In addition, the positions of the variant bases and the variant amino acid residues are underlined.

Results

Variants are reported individually but any combination of all or a select subset of variants are also included as contemplated NOVX embodiments of the invention.

NOV1

TABLE 21 cSNP and Coding Variants for NOV1

| Variant | Base Position of cSNP | Wild Type | Variant | Amino Acid Change |
|---|---|---|---|---|
| 13375592 | 221 | A | G | Arg -> Gly at aa 72 |
| 13373919 | 299 | G | C | Ala -> Pro at aa 98 |
| 13373884 | 301 | T | C | silent |
| 13373885 | 399 | C | T | Ser -> Leu at aa 131 |
| 13375593 | 428 | G | A | Gly -> Ser at aa 141 |
| 13375594 | 735 | C | A | Thr -> Asn at aa 243 |
| 13375595 | 867 | A | G | Asp -> Gly at aa 287 |

NOV4

TABLE 22 cSNP and Coding Variants for NOV4

| Variant | Base Position of cSNP | Wild Type | Variant | Amino Acid Change |
|---|---|---|---|---|
| 13375361 | 809 | G | A | Val -> Ile at aa 258 |
| 13375360 | 1062 | C | T | silent |

NOV7

TABLE 23 cSNP and Coding Variants for NOV7

| Variant | Base Position of cSNP | Wild Type | Variant | Amino Acid Change |
|---|---|---|---|---|
| 13375931 | 289 | A | T | Ser -> Cys at aa 87 |

NOV9

TABLE 24 cSNP and Coding Variants for NOV9

| Variant | Base Position of cSNP | Wild Type | Variant | Amino Acid Change |
|---|---|---|---|---|
| 13376492 | 298 | C | G | Asn -> Lys at aa 53 |
| 13376491 | 551 | C | G | His -> Asp at aa 138 |

NOV11

TABLE 25 cSNP and Coding Variants for NOV9

| Variant | Base Position of cSNP | Wild Type | Variant | Amino Acid Change |
|---|---|---|---|---|
| 13376495 | 864 | G | A | Gly -> Asp at aa 204 |
| 13376494 | 1051 | G | A | silent |
| 13376493 | 1171 | C | T | silent |

NOV12a

TABLE 26 cSNP and Coding Variants for NOV12a

| Variant | Base Position of cSNP | Wild Type | Variant | Amino Acid Change |
|---|---|---|---|---|
| 13376475 | 156 | C | T | silent |
| 13376474 | 407 | T | C | Ile -> Thr at aa 105 |
| 13376473 | 413 | A | G | Asn -> Ser at aa 107 |
| 13376472 | 549 | A | G | silent |
| 13376471 | 841 | G | A | Val -> Met at aa 250 |

NOV12b

One or more consensus positions (Cons. Pos.) of the nucleotide sequence have been identified as SNPs. "Depth" represents the number of clones covering the region of the SNP. The Putative Allele Frequency (Putative Allele Freq.) is the fraction of all the clones containing the SNP.

TABLE 27 cSNP and Coding Variants for NOV12b

| Cons. Pos. | Depth | Wild Type | Variant | Putative Allele Freq. |
|---|---|---|---|---|
| 964 | 46 | T | C | 0.065 |
| 973 | 46 | T | A | 0.065 |

NOV13

TABLE 28 cSNP and Coding Variants for NOV13

| Variant | Base Position of cSNP | Wild Type | Variant | Amino Acid Change |
|---|---|---|---|---|
| 13376476 | 461 | T | C | silent |

NOV15a

TABLE 29 cSNP and Coding Variants for NOV15a

| Variant | Base Position of cSNP | Wild Type | Variant | Amino Acid Change |
|---|---|---|---|---|
| 13376483 | 229 | T | C | Ser -> Pro at aa 27 |
| 13376484 | 265 | A | G | Lys -> Glu at aa 39 |
| 13376485 | 315 | G | A | silent |
| 13376486 | 376 | A | G | Arg -> Gly at aa 76 |
| 13376487 | 465 | C | T | silent |
| 13374260 | 808 | G | A | Ala -> Thr at aa 220 |
| 13374259 | 857 | A | G | Gln -> Arg at aa 236 |
| 13374258 | 958 | G | A | Gly -> Arg at aa 270 |

NOV15d

One or more consensus positions (Cons. Pos.) of the nucleotide sequence have been identified as SNPs as shown in Table 2. "Depth" represents the number of clones covering the region of the SNP. The Putative Allele Frequency (Putative Allele Freq.) is the fraction of all the clones containing the SNP.

TABLE 30 cSNP and Coding Variants for NOV15d

| Cons. Pos. | Depth | Wild Type | Variant | Putative Allele Freq. |
|---|---|---|---|---|
| 494 | 50 | G | A | 0.040 |
| 512 | 49 | G | T | 0.184 |
| 569 | 70 | A | G | 0.043 |
| 679 | 113 | G | A | 0.018 |
| 682 | 113 | G | A | 0.018 |
| 687 | 114 | G | A | 0.026 |
| 731 | 114 | A | G | 0.018 |
| 736 | 114 | A | G | 0.035 |
| 751 | 113 | C | T | 0.018 |
| 759 | 114 | T | C | 0.026 |
| 763 | 114 | A | G | 0.018 |
| 792 | 132 | A | C | 0.030 |
| 794 | 132 | A | T | 0.015 |
| 800 | 132 | A | G | 0.015 |
| 840 | 169 | G | A | 0.012 |
| 847 | 169 | A | G | 0.024 |
| 856 | 171 | T | C | 0.064 |
| 861 | 171 | C | T | 0.023 |
| 1151 | 55 | T | A | 0.036 |
| 1152 | 55 | T | C | 0.036 |
| 1228 | 80 | G | T | 0.025 |
| 1234 | 81 | C | T | 0.025 |
| 1333 | 87 | T | C | 0.023 |
| 1431 | 91 | G | A | 0.022 |
| 1456 | 90 | A | G | 0.022 |
| 1493 | 89 | A | G | 0.022 |
| 1530 | 71 | G | A | 0.028 |
| 1727 | 120 | A | G | 0.025 |
| 1756 | 78 | T | C | 0.026 |
| 1845 | 67 | T | C | 0.030 |
| 1857 | 67 | C | T | 0.239 |
| 1885 | 59 | G | A | 0.034 |
| 7552 | 19 | C | T | 0.263 |

NOV16

TABLE 31 cSNP and Coding Variants for NOV16

| Variant | Base Position of cSNP | Wild Type | Variant | Amino Acid Change |
|---|---|---|---|---|
| 13375814 | 267 | C | T | silent |
| 13375816 | 488 | A | G | Asn -> Ser at aa 153 |
| 13375815 | 690 | C | A | silent |

NOV19

TABLE 32 cSNP and Coding Variants for NOV19

| Variant | Base Position of cSNP | Wild Type | Variant | Amino Acid Change |
|---|---|---|---|---|
| 13374210 | 237 | G | A | Ser -> Asn at aa 36 |
| 13374212 | 3536 | A | G | Thr -> Ala at aa 1136 |
| 13374213 | 3567 | A | G | Gln -> Arg at aa 1146 |

NOV20

One or more consensus positions (Cons. Pos.) of the nucleotide sequence have been identified as SNPs as shown in Table 2. "Depth" represents the number of clones covering the region of the SNP. The Putative Allele Frequency (Putative Allele Freq.) is the fraction of all the clones containing the SNP.

TABLE 33 cSNP and Coding Variants for NOV20

| Cons. Pos. | Depth | Wild Type | Variant | Putative Allele Freq. |
|---|---|---|---|---|
| 212 | 8 | G | A | 0.250 |
| 311 | 12 | A | G | 0.250 |
| 523 | 9 | A | G | 0.222 |
| 554 | 8 | A | G | 0.250 |

OTHER EMBODIMENTS

Although particular embodiments have been disclosed herein in detail, this has been done by way of example for purposes of illustration only, and is not intended to be limiting with respect to the scope of the appended claims, which follow. In particular, it is contemplated by the inventors that various substitutions, alterations, and modifications may be made to the invention without departing from the spirit and scope of the invention as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims.

SEQUENCE LISTING (411 sequences)

SEQ ID NO: 1 - DNA, 1138 bp, Homo sapiens
gtccaaaatgtggctgcttttaacaacaacttgtttgatctgtggaactttaaatgctggtggattccttgatttggaaaatgaagtgaatcctgaggtgtggatgaatactagtgaaatcatcatctacaatggctaccccagtgaagagtatgaagtcaccactgaagatgggtatatactccttgtcaacagaattccttatgggcgaacacatgctaggagcacaggtccccggccagttgtgtatatgcagcatgccctgtttgcagacaatgcctactggcttgagaattatgctaatggaagccttggattccttctagcagatgcaggttatgatgtatggatgggaaacagtcggggaaacacttggtcaagaagacacaaaacactctcagagacagatgagaaattctgggcctttggttttgatgaaatggccaaatatgatctcccaggagtaatagacttcattgtaaataaaactggtcaggagaaattgtatttcattggacattcacttggcactacaatagggtttgtagccttttccaccatgcctgaactggcacaaagaatcaaaatgaattttgccttgggtcctacgatctcattcaaatatcccacgggcatttttaccaggttttttctacttccaaattccataatcaaggctgtttttggtaccaaaggtttctttttagaagataagaaaacgaagatagcttctaccaaaatctgcaacaataagatactctggttgatatgtagcgaatttatgtccttatgggctggatccaacaagaaaaatatgaatcagctttaccactctgatgaattcagagcttatgactggggaaatgacgctgataatatgaaacattacaatcagagtcatccccctatatatgacctgactgccatgaaagtgcctactgctatttgggctggtggacatgatgtcctcgtaacaccccaggatgtggccaggatactccctcaaatcaagagtcttcattactttaagctattgccagattggaaccactttgattttgtctggggcctcgatgcccctcaacggatgtacagtgaaatcatagctttaatgaaggcatattcctaaatgcaatgc

SEQ ID NO: 2 - protein, 373 aa, Homo sapiens
MWLLLTTTCLICGTLNAGGFLDLENEVNPEVWMNTSEIIIYNGYPSEEYEVTTEDGYILLVNRIPYGRTHARSTGPRPVVYMQHALFADNAYWLENYANGSLGFLLADAGYDVWMGNSRGNTWSRRHKTLSETDEKFWAFGFDEMAKYDLPGVIDFIVNKTGQEKLYFIGHSLGTTIGFVAFSTMPELAQRIKMNFALGPTISFKYPTGIFTRFFLLPNSIIKAVFGTKGFFLEDKKTKIASTKICNNKILWLICSEFMSLWAGSNKKNMNQLYHSDEFRAYDWGNDADNMKHYNQSHPPIYDLTAMKVPTAIWAGGHDVLVTPQDVARILPQIKSLHYFKLLPDWNHFDFVWGLDAPQRMYSEIIALMKAYS

SEQ ID NO: 3 - DNA, 12348 bp, Homo sapiens
atggcgaggcggccgccgtggcggggcctcggggaacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcaggtgcaggatcagggccagggaacttgtgtcctgatgaccctactggcccaggaggcctggggccaaaactcagggtcagagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactcaggacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggcgcagactccgactctgacagtgacctgtccttggaggaggagaggagtctctccattccatcttcagaaagcgaggacaatggccggacgcgggggcgcttccaacggccactctgccgagcagcccagagtgagaggctcctcacccaccccaaagatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgcagtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggagagcctctgtgtcccgggaccagtagacacagggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcgccctcactcgctgtctcctcagatgtgaaacagttggaaccagagctgcttctcaggaataatttgctctcaggaatacccgagaaggtacagggcagcgtgggtgccaatgggcagtccctggaggatacagagtga

SEQ ID NO: 4 - protein, 4115 aa, Homo sapiens
MARRPPWRGLGERSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQVQDQGQGTCVLMTLLAQEAWGQNSGSELVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALRTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVESLCVPGPVDTGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAGPLLSACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSPSLAVSSDVKQLEPELLLRNNLLSGIPEKVQGSVGANGQSLEDTE

SEQ ID NO: 5 - DNA, 1438 bp, Homo sapiens
tatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtctggaggaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagccttgacaaattgtgagtaaa

SEQ ID NO: 6 - protein, 394 aa, Homo sapiens
MQRVNMIMAESPGLITICLLGYLLSAECTVFLDHENANKILNRPKRYNSGKLEEFVQGNLERECLEEKCSFEEAREVFENTERTTEFWKQYVDGDQCESNPCLNGGSCKDDINSYECWCPFGFEGKNCELDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 7 - DNA, 1108 bp, Homo sapiens
cgaccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcacagcctcgatggggagcactttgccatggagatgcacatagtacatgagaaagagaaggggacatcgaggaatgtgaaagaggcccaggaccctgaagacgaaattgcggtgctggcctttctggtggagatcgggagaatgaactggccaccaccactggctccctgcagactttctcaagacccttccctccctttccaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccgg

SEQ ID NO: 8 - protein, 336 aa, Homo sapiens
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEIGRMNWPPPLAPCRLSQDPSLPFQAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 9 - DNA, 1806 bp, Homo sapiens
aacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaaagccctgggcagcaccaacctcagccgcacggttgacgtctactttgggccccggatgaccacagaaccccaatccttgctcgtggatctgggctctgatgccatcttaagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggcaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggactgtggggtactttacagaggacaccagaatggcccacttccaggacagcctcccagcgcctctgccactgccttccttcgaagctctgatca

SEQ ID NO: 10 - protein, 548 aa, Homo sapiens
NKAIPGGKETSVTIDIQHPPLVNLSVEPQPVLEDNVVTFHCSAKANPAVTQYRWAKRGQIIKEASGEVYRTTVDYTYFSEPVSCEVTKALGSTNLSRTVDVYFGPRMTTEPQSLLVDLGSDAILSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 11 - DNA, 2405 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccaatggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagcccctgcagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacggtgagcccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcagatctccccggagctgtcggccctggctgtgtactgccacgccacccgcctgcgacccgacacatcacctggaggactaggaagcagccaggtgaagaggggagagcgctttccagacaggaggaacaggttgttgaaggcctgggggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtcc

SEQ ID NO: 12 - protein, 736 aa, Homo sapiens
MGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDQWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAPAAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTVSPYPVILSLENHCGLEQQAAMARHLCTILGDMLVTQALDSPNPEELPSPEQLKGRVLVKGKKLPAARSEDGRALSDREEEEEDDEEEEEEVEAAAQRQISPELSALAVYCHATRLRPDTSPGGLGSSQVKRGERFPDRRNRLLKAWGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 13 - DNA, 1059 bp, Homo sapiens
aaacatttgctaaccaggccagtgacagaaatggattcgaaataccagtgtgtgaagctgaatgatggtcacttcatgcctgtcctgggatttggcacctatgcgcctgcagaggtacctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatggaaggccctggagaaatgcagagatgcaggtttaaccaggtccatcagggtgtccagtttcaatcacaagctgctggaactcatcctcaacaagccagggctcaggtacaagcccacctgcaaccaggtggaatgtcacccttacctcaaccagagcaaactcctggagttctgcaagtccaaggacattgttctagttgcctacagtgccctgggatcccaaagagacccacagtgggtggatcccgactgcccacatctcttggaggagccgatcttgaaatccattgccaagaaacacagtcgaagcccaggccaggtcgccctgcgctaccagctgcagcggggagtggtggtgctggccaagagcttctctcaggagagaatcaaagagaacttccaggtatttgactttgagttgactccagaggacatgaaagccattgatggcctcaacagaaatctccgatatctttctttcttcagtcttgctggacaccctgattatccattttcagacaaatattaacatggaggactttgcgtgagttctaccagaggccctgtgtgtagatggtgacacaga

SEQ ID NO: 14 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWKALEKCRDAGLTRSIRVSSFNHKLLELILNKPGLRYKPTCNQVECHPYLNQSKLLEFCKSKDIVLVAYSALGSQRDPQWVDPDCPHLLEEPILKSIAKKHSRSPGQVALRYQLQRGVVVLAKSFSQERIKENFQVFDFELTPEDMKAIDGLNRNLRYLSFFSLAGHPDYPFSDKY

SEQ ID NO: 15 - DNA, 879 bp, Homo sapiens
attataactattgtcacaatataatgaaagaacattcaaaaacgttctcatatgcctttgattttttggatttaaaaaggaaaaaagcaatttgggctatttatgcagtttgcagaattatagatgacagtattgataaatacaaagaccttgagcaattaaacggcatagctagagatttagatgtgatttatagcgattgtgattatattcaagcctatcaaagtgatgcagctattatgaatgctttaagtaatacattgaatacatattcaatacctaaaaaaccttttgaatctttaattcaatatgtgaaggaagatttagttttaaaagaaatgaaaactgattcagatttatatgagtattgctatggtgtggtaggtactgtcggtgaattgttaactcctatattaacttcatcaaatgaaaataatttcgagcaagctgaagaagctgcgattgctttaggcaaggcaatgcaaataactaatattttaagagatgtcggcgaagattttcaaaatggaagaatttatctaagtgttgaaaaattagctcaatatcgagttaatctacattctatatattatgaaggagtttcgccaaattatatagaactgtgggaaagttacgctacagagacagttaggttatatgatattgcattaaacggtattaattattttgacgaagaggtacgttacattatcgaattagctgcgatagcttatcatgaaatacttgtggaagtaaggaaggcaaactatacgttgcataagaaagtatatgtaagcaaattgaaaaaaatgaaaatttatcgtgaacttagtgcgaaatataataggagtgaaacattatgaagattgcagttatagg

SEQ ID NO: 16 - protein, 279 aa, Homo sapiens
MKEHSKTFSYAFDFLDLKRKKAIWAIYAVCRIIDDSIDKYKDLEQLNGIARDLDVIYSDCDYIQAYQSDAAIMNALSNTLNTYSIPKKPFESLIQYVKEDLVLKEMKTDSDLYEYCYGVVGTVGELLTPILTSSNENNFEQAEEAAIALGKAMQITNILRDVGEDFQNGRIYLSVEKLAQYRVNLHSIYYEGVSPNYIELWESYATETVRLYDIALNGINYFDEEVRYIIELAAIAYHEILVEVRKANYTLHKKVYVSKLKKMKIYRELSAKYNRSETL

SEQ ID NO: 17 - DNA, 939 bp, Homo sapiens
ttagcaagtcgcattatcctcactaaagggaacaaaagctggagctccaccgcggtggcggccgctctagaactagtggatcccccgggctgcaggaattcggcacgagggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcaatcagcatcttctagcaggcctaccagttctccggcatctcaacttaaaagggaatcactttcaagatgggactatcacgaagaccaacctacttcagaccgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctacctcaatctggctgccaacagcattaacatcatctcaccccgtctcctccctatcttgtcccagcagagcaccattaatttaagtcataaccccctggaa

SEQ ID NO: 18 - protein, 260 aa, Homo sapiens
MAFDVSCFFWVVLFSAGCKVITSWDQMCIEKEANKTYNCENLGLSEIPDTLPNTTEFLEFSFNFLPTIHNRTFSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSTSIWLPTALTSSHPVSSLSCPSRAPLI

SEQ ID NO: 19 - DNA, 2349 bp, Homo sapiens
tattttaatccccccccccccccgagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgtttttgtttatctcaaaataatgttgaaatacaattatcaatgaaaaaactttcgtttttttttttggttggttttgtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaatttttttgtatttttagtagagacagggtttcatcatgttggccagactggcctcgaattcctgacctcaggcaatccacccgcctcggcctcccaaagagctgggattacaggcgtgagccaccgcaccctgccgaaaaaaactttttttttttgagacggaggctcgctctgtcccccaggtctggatgtgcagtggcgagatttcagctcactgacaagctccgcctcccggggttcacgccattctcctgcctcagcctcccgagtagctggggagccagcgcgcccagcctaaaaaacttttcaggtcaatattactacgatttaactttacgagtgtggacctgtgatttaatcggctattagctaagaatagcgtcaaattattcgtgtgtcattgtggcttgaacattgatggctaacccttcctggaaagggatgaaggcaaagtaatatttcttttagtggtagttcaggagaccatgtggtctcctttgtctaccaatttacccgatcatgtgttattaaaacaccccttctggaggacaaagaggggttacacacacaggggtcttgtcgggcaacacagcaggtccggtgaccatcgggcggcggggtctcgcggctccaactcacccggcacacacgacaacagacgggctgatctcggggtaccggaagcctcgtcgaaacaaatatcgccgttttgctcgacgccaaactgctat

SEQ ID NO: 20 - protein, 330 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 21 - DNA, 1411 bp, Homo sapiens
caagtgtttgtgagtctgtgtgtctgagtttgcaagtgagtgtgtgtctgtgtgccgggcgttgtgtctgattgggcaaggttccaggggtgctcgcttgagtcctgagctgggacaacgccttgactcttcttctttaagacctccaagcctcagggactctgggaatcaaggggtgtttcttcttgttttgtttgaggaggaatgagaagggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgagggaaggctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcgggtgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcaaccttaccttggggctggggaaaaggactgtgtgaaaggaagcgccttttcaaccctttgctatgatttccttccaaggtcactcttggcccctggaagcttaaagatctacctggaaaaaac

SEQ ID NO: 22 - protein, 342 aa, Homo sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKAPRDIQARMRIHNNRVGRQVVTENLKRKCKCHGTSGSCQFKTCWRAAPEFRAVGAALRERVGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 23 - DNA, 1196 bp, Homo sapiens
gcgcgccgcctggttcccgggaagactcgccagcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacttgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctga

SEQ ID NO: 24 - protein, 354 aa, Homo sapiens
MDMMLLVQGACCSNQWLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 25 - DNA, 1165 bp, Homo sapiens
cgggaagactcgccagcacctgggggtgggggagtgcgagctgaaagctgctggagagtgagcagccctagcagggatggacatgatgctgttggtgcagagtgcctgttgctcgaaccagcggctggcggcggtgcttctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacttgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttt

SEQ ID NO: 26 - protein, 354 aa, Homo sapiens
MDMMLLVQSACCSNQRLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 27 - DNA, 2069 bp, Homo sapiens
gcttctaggccttctcagtagatggagctaagtaatatatgtatatatactaacccacagatataaatatgtctataattatttctatatttatccattcgtgtatatgttaagataaacatgatggagacccttcaaatttgcttatgttctttttcagcctatagaccagatataataattagcttttcttctcttgcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagttttaaaaa

SEQ ID NO: 28 - protein, 534 aa, Homo sapiens
MGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 29 - DNA, 1666 bp, Homo sapiens
ttccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggcttttttgcctatatgtgatttgcaatggggtcagactcctcaatagttataaatgtgaccttgaatataaatccctattatttgtttttcaggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcacaggtgtagtggaaattcccgcctacaccttcgtgtgcatcgccatggacaaggtcgggaggagaacagtcctggcctactctcttttctgcagtgcactggcctgtggtgtcgttatggtgatcccccaggtgagttatcttctgggtgtggtgacagctatggttggaaaatttgccatcggggcagcatttggcctcatttatctttatacagctgagctgtatccaaccattgtaaggtcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatg

SEQ ID NO: 30 - protein, 526 aa, Homo sapiens
MGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLFCLYVICNGVRLLNSYKCDLEYKSLLFVFQVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLTGVVEIPAYTFVCIAMDKVGRRTVLAYSLFCSALACGVVMVIPQVSYLLGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 31 - DNA, 1192 bp, Homo sapiens
tgctgagggtgcatttatgtttcagaaccaccgggaggaactgggccattctaacacccgttgctaccatgctggccacccgcctctccagacccctgtcacggctcccaggaaaaaccctaagtgcctgtgatagagaaaatggagcaaggcgcccactattgcttggttctacttcctttatcccgattggccgtcggacttatgccagtgcggcggagccggtgagtggaaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggtatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggtcgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtgg

SEQ ID NO: 32 - protein, 343 aa, Homo sapiens
MLATRLSRPLSRLPGKTLSACDRENGARRPLLLGSTSFIPIGRRTYASAAEPVSGKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 33 - DNA, 1166 bp, Homo sapiens
tgctgagggtgcatttatgtttcagaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggattcctggtggaaggggaggggagggaggaacccatata

SEQ ID NO: 34 - protein, 343 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 35 - DNA, 8675 bp, Homo sapiens
tttggcctcgggccagaattcggcacgaggggtctggagcttggaggagaagtctgaactaaggataaactaaagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaagaagttaccgccttcccatactcagtcctccccccagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcctgtgcttgcagctcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgctcactatttggataagatagttaaagacaagataggatataaagagggttgtcctggtctgtgcaacagcaatggaagatgtaccctggaccaaaatggcggacattgtgtgtgccagcctggatggagaggagcaggctgtgacgtagccatggagactctttgcacagatagcaaggacaatgaaggggatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatggagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactacgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaggcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaaaaaaaaaaaaaag

SEQ ID NO: 36 - protein, 2725 aa, Homo sapiens
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKKLPPSHTQSSPQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACSSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIAHYLDKIVKDKIGYKEGCPGLCNSNGRCTLDQNGGHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMEKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKGMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 37 - DNA, 8645 bp, Homo sapiens
tttggcctcgggccagaattcggcacgaggggtctggagcttggaggagaagtctgaactaaggataaactaaagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcctgtgcttgcagctcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgctcactatttggataagatagttaaagacaagataggatataaagagggttgtcctggtctgtgcaacagcaatggaagatgtaccctggaccaaaatggcggacattgtgtgtgccagcctggatggagaggagcaggctgtgacgtagccatggagactctttgcacagatagcaaggacaatgaaggggatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatggagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactacgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaggcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaacttta

SEQ ID NO: 38 - protein, 2721 aa, Homo sapiens
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACSSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIAHYLDKIVKDKIGYKEGCPGLCNSNGRCTLDQNGGHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMEKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKGMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 39 - DNA, 8473 bp, Homo sapiens
ttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatgagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaagagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggaaaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgctcactatttggataagatagttaaagacaagataggatataaagagggttgtcctggtctgtgcaacagcaatggaagatgtaccctggaccaaaatggcggacattgtgtgtgccagcctggatggagaggagcaggctgtgacgtagccatggagactctttgcacagatagcaaggacaatgaaggggatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatggagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactacgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaggcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaacttta

SEQ ID NO: 40 - protein, 2628 aa, Homo sapiens
MDVKERRPYCSLTKSRREKERRYTNSSADNEECRVPTQKSYSSSETLKAFDHDSSRLLYGNRVKDLVHREADEFTRQEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGKSCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIAHYLDKIVKDKIGYKEGCPGLCNSNGRCTLDQNGGHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMEKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKGMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 41 - DNA, 8487 bp, Homo sapiens
actcactatagggctcgagcggccgcccgggcaggtcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatgagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaagagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcctgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccaacctgtaatcagagagcctgccacccccgctgtgccgagcacgggacctgcaaggatggcaagtgtgaatgcagccatggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatggagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactacgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaggcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaaaaaaaaaaaaaag

SEQ ID NO: 42 - protein, 2613 aa, Homo sapiens
MDVKERRPYCSLTKSRREKERRYTNSSADNEECRVPTQKSYSSSETLKAFDHDSSRLLYGNRVKDLVHREADEFTRQEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPTCNQRACHPRCAEHGTCKDGKCECSHGWNGEHCTIEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMEKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKGMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 43 - DNA, 956 bp, Homo sapiens
ggcggggcggcggggcggccggcggcggccatgggagatatcccagccgtgggcctcagctcctggaagcaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctctagtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccagaactaaaaatcacaaagactatcctttccacatagaatactgaggacgcttccccttcct

SEQ ID NO: 44 - protein, 302 aa, Homo sapiens
MGDIPAVGLSSWKQASPGKVTEAVKEAIDAGYRHFDCAYFYHNEREVGAGIRCKIKEGAVRREDLFIATKLWCTCHKKSLVETACRKSLKALKLNYLDLYLIHWPMGFKPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSSEGVDLIDNPVIKRIAKEHGKSPAQILIRFQIQRNVIVIPGSITPSHIKENIQVFDFELTQHDMDNILSLNRNLRLAMFPRTKNHKDYPFHIEY

SEQ ID NO: 45 - DNA, 875 bp, Homo sapiens
ggcggggcggccggcggcggccatgggagatatcccagccgtgggcctcagctcctggaagcaggcttctccaggaaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagggtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccaca

SEQ ID NO: 46 - protein, 251 aa, Homo sapiens
MGDIPAVGLSSWKQASPGKVTEAVKEAIDAGYRHFDCAYFYHNEREVGAGIRCKIKEGAVRREDLFIATKLWCTCHKKSLVETACRKGLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPM

SEQ ID NO: 47 - DNA, 752 bp, Homo sapiens
ggcggggcggccggcggcggccatgggagatatcccagccgtgggcctcagctcctggaagcaggcttctccaggtaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggagattttgatccgatttcaaatccagaggaatgtgatagtgatccccggatctatcaccccaagtcacattaaagagaatatccaggtgtttgattttgaattaacacagcacgatatggataacatcctcagcctaaacaagaatctccgactggccatgttccccatgtaaatatggctccttctttttaaaacagagggaagaatatacagattgaatgattggtgtctgaatagaactaaaaatcacaaagactatcctttccaca

SEQ ID NO: 48 - protein, 210 aa, Homo sapiens
MGDIPAVGLSSWKQASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEILIRFQIQRNVIVIPGSITPSHIKENIQVFDFELTQHDMDNILSLNKNLRLAMFPM

SEQ ID NO: 49 - DNA, 785 bp, Homo sapiens
ggcggggcggcggggcggccggcggcggccatgggagatatcccagccgtgggcctcagctcctggaagcaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccagaactaaaaatcacaaagactatcctttccacatagaatactgaggacgcttccccttcct

SEQ ID NO: 50 - protein, 245 aa, Homo sapiens
MGDIPAVGLSSWKQASPGKVTEAVKEAIDAGYRHFDCAYFYHNEREVGAGIRCKIKEGAVRREDLFIATKLWCTCHKKSLVETACRKSLKALKLNYLDLYLIHWPMGFKPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPRTKNHKDYPFHIEY

SEQ ID NO: 51 - DNA, 937 bp, Homo sapiens
ggcggggcggcggggcggccggcggcggccatgggagatatcccagccgtgggcctcagctcctggaagcaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccaca

SEQ ID NO: 52 - protein, 269 aa, Homo sapiens
MGDIPAVGLSSWKQASPGKVTEAVKEAIDAGYRHFDCAYFYHNEREVGAGIRCKIKEGAVRREDLFIATKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPM

SEQ ID NO: 53 - DNA, 884 bp, Homo sapiens
gaattcaaaaaaaaaagaaaaaaaaaaaaaaaaaaaaaaaaaaaaaagagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaaaaaaaaaaaaaagaattc

SEQ ID NO: 54 - protein, 240 aa, Homo sapiens
MKAAVLTLAVLFLTGSQARHFWQQDEPPQSPWDRVKDLATVYVDVLKDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 55 - DNA, 751 bp, Homo sapiens
gaattcaaaaaaaaaagaaaaaaaaaaaaaaaaaaaaaaaaaaaaaagagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcgccagcgcttggccgagcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaac

SEQ ID NO: 56 - protein, 207 aa, Homo sapiens
MKAAVLTLAVLFLTGSQARHFWQQDEPPQSPWDRVKDLATVYVDVLKDSVTSTFSKLREQLGPVTQEFWDNLEKETEGLRQEMSKDLEEVKAKVQPYLDDFQKKWQEEMELYRQKVEPLRAELQEGARQKLHELRQRLAERLEALKENGGARLAEYHAKATEHLSTLSEKAKPALEDLRQGLLPVLESFKVSFLSALEEYTKKLNTQ

SEQ ID NO: 57 - DNA, 3839 bp, Homo sapiens
gtgaggccaggcctgcaggtgggtgtcgggctgctcaggctttcagtggggagtgggtgtgggatgggaggctagggaacccccattcacgcaccttctctgcccccttccagcttctcacgttctcactatgtctgctccagacgaagggagacgggatccccccaaaccgaagggcaagccccccgcccccatgcagaccctgggcagcttctttgggtccctgcctggcttcagctctgcccggaacctggtggccaacgcacatagctcggtcggggccaaagacctggtgtgttccaagatgtccagggccaaggatgccgtgtcctccggggtggccagcgtggtggacgtggctaagggagtggtccagggaggcctggacaccactcggtctgcacttacgggcaccaaggaggtggtgtccagcggggtcacaggggccatggacatggctaagggggccgtccaagggggtctggacacctcgaaggctgtcctcaccggcaccaaggacacggtgtccactgggctcacgggggcagtgaatgtggccaaagggaccgtacaggccggtgtggacaccaccaagactgtgctgaccggcaccaaagacacagtgactactggggtcatgggggcagtgaacttggccaaagggactgtccagactggcgtggaaacctccaaggctgtgctgaccggcaccaaagatgctgtgtccactgggctcacaggggcagtgaatgtggccagaggaagcattcagaccggtgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccaccaagactgtcctaactggcaccaagaacactgtctgcagtggggtgaccggtgccgtgaacttggccaaagaggccatccaggggggcctggataccaccaagtctatggtcatgggtacgaaagacacgatgtccactgggctcacaggggcagcgaatgtggccaagggggccatgcaaactgggctgaacacaacccaaaatatcgcaacaggtacaaaggacaccgtctgcagtggggtgactggtgccatgaatttggccagaggaaccatccagacaggcgtggacaccaccaagatcgttctaactggtaccaaggacactgtctgcagtggggtcaccggtgctgcgaatgtggccaaaggggccgtccagggcggcctggacactacaaagtctgtcctgactggcactaaagatgctgtgtccactgggctcacaggggctgtgaacgtggccaaagggaccgtccagaccggcgtagacaccaccaagactgtcctaaccggcaccaaggacaccgtctgcagtggggtgaccagtgctgtgaacgtggccaaaggggccgtccaggggggcctggacaccaccaagtctgtggtcataggtacaaaagacacgatgtccactgggctcacgggggcagcgaatgtggccaagggggctgtccagacaggtgtagacacagccaagaccgtgctgaccggcaccaaggacacagtgactactgggctcgtgggggcagtgaatgtcgccaaagggaccgtccagacaggcatggacaccaccaaaactgtcctaaccggtaccaaggacaccatctacagtggggtcaccagtgccgtgaacgtggccaagggggctgtgcaaactgggctgaaaacgacccaaaatatcgcgacaggtacaaagaacacctttggcagtggggtgaccagtgctgtgaatgtggccaaaggggctgcccagacaggtgtagacacggccaagaccgtgctgaccggcaccaaggacacagtcactactgggctcatgggggcagtgaatgtcgccaaagggactgtccagaccagtgtggacaccaccaagactgtcctaactggtaccaaggacaccgtctgcagtggggtgaccggtgctgcgaatgtggccaaaggggccatccaagggggcctggacactacaaagtctgtcctgactggcactaaagatgctgtgtccactgggctcacaggggctgtgaagttggccaaagggactgtccagaccggcatggacaccaccaagactgtgttaactggtaccaaggatgctgtgtgcagtggggtgaccggtgctgcgaatgtggccaagggggccgtccagatgggtgtagacacggccaagaccgtgctgaccggtaccaaggacactgtctgcagtggggtcaccggtgctgcgaacgtggccaagggtgctgtgcaaactgggctgaaaacgacccaaaatatcgcaacaggtacaaagaacacccttggcagtggggtgaccggtgctgcgaaagtggccaaaggggccgtccaggggggcctggacactacaaagtctgtcctgactggcactaaagatgccgtgtccactgggctcacaggggctgtgaacttggccaaagggactgtccagaccggcgtggacaccagcaagactgtcctgaccggtaccaaggacaccgtctgcagtggagtcactggtgccgtaaatgtggccaaagggaccgtccagacaggtgtggacacagccaagacggtgctgagtggcgctaaggatgcagtgactactggagtcacgggggcagtgaatgtggccaaaggaaccgtgcagaccggcgtggacgcctccaaggctgtgcttatgggtaccaaggacactgtcttcagtggggttaccggtgccatgagcatggccaaaggggccgtccaggggggcctggacaccaccaagacagtgctgaccggaaccaaagacgcagtgtccgctgggctcatggggtcagggaacgtggcgacaggggccacccacactggcctcagcaccttccagaactggttacctagtacccccgccacctcctggggtggactcaccagttccaggaccacagctcagctggctgcctcccagcctgggccaaaggtgctgtcggcggaacaggggagctacttcgttcgtttaggtgacctgggtcccagcttccgccagcgggcatttgaacacgcggtgagccacctgcagcacggccagttccaagccagggacactctggcccagctccaggactgcttcaggctgattgaaaaggcccagcaggctccagaagggcagccacgtctggaccagggctcaggtgccagtgcggaggacgctgctgtccaggagagggtctgcggccttctccggcagctgcacacggcctacagtggcctggtctccagcctccagggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggcctacagcacaatcccccgctcagctggctggtagggcccttcgccttgcccgctggcgggcagtagctgtaggagcctgcaggcccggcgcggggtc

SEQ ID NO: 58 - protein, 1225 aa, Homo sapiens
MSAPDEGRRDPPKPKGKPPAPMQTLGSFFGSLPGFSSARNLVANAHSSVGAKDLVCSKMSRAKDAVSSGVASVVDVAKGVVQGGLDTTRSALTGTKEVVSSGVTGAMDMAKGAVQGGLDTSKAVLTGTKDTVSTGLTGAVNVAKGTVQAGVDTTKTVLTGTKDTVTTGVMGAVNLAKGTVQTGVETSKAVLTGTKDAVSTGLTGAVNVARGSIQTGVDTSKTVLTGTKDTVCSGVTGAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTSAVNVAKGAAQTGVDTAKTVLTGTKDTVTTGLMGAVNVAKGTVQTSVDTTKTVLTGTKDTVCSGVTGAANVAKGAIQGGLDTTKSVLTGTKDAVSTGLTGAVKLAKGTVQTGMDTTKTVLTGTKDAVCSGVTGAANVAKGAVQMGVDTAKTVLTGTKDTVCSGVTGAANVAKGAVQTGLKTTQNIATGTKNTLGSGVTGAAKVAKGAVQGGLDTTKSVLTGTKDAVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTAQLAASQPGPKVLSAEQGSYFVRLGDLGPSFRQRAFEHAVSHLQHGQFQARDTLAQLQDCFRLIEKAQQAPEGQPRLDQGSGASAEDAAVQERVCGLLRQLHTAYSGLVSSLQGLPAELQQPVGRARHSLCELYGIVASAGSVEELPAERLVQSREGVHQAWQGLEQLLEGLQHNPPLSWLVGPFALPAGGQ

SEQ ID NO: 59 - DNA, 810 bp, Homo sapiens
aggcctgcaggtgggtgtcgggctgctcaggctttcagtggggagtgggtgtgggatgggaggctagggaacccccattcacgcaccttctctgcccccttccagcttctcacgttctcactatgtctgctccagacgaagggagacgggatccccccaaaccgaagggcaagaccctgggcagcttctttgggtccctgcctggcttcaactctgcccggaacctggtggccaacgcacatagctcggcgagagcccggccggccgctgaccccacaggagcgcctgctgccgaggctgcccaaccacaggctcaggtggctgcccacccagagcagacggccccatggacggagaaggagctgcaaccttcggaaaagattgaaaaggcccagcaggctccagaagggcagccacgtctggaccagggctcaggtgccagtgcggaggacgctgctgtccaggaggagcgggatgccggggttctgtccagggtctgcggccttctccggcagctgcacacggcctacagtggcctggtctccagcctccggggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggcctacagcacaatcccccgctcagctggctggtagggcccttcgccttgcccgctggcgggcagtagctgtaggagcctgcag

SEQ ID NO: 60 - protein, 223 aa, Homo sapiens
MSAPDEGRRDPPKPKGKTLGSFFGSLPGFNSARNLVANAHSSARARPAADPTGAPAAEAAQPQAQVAAHPEQTAPWTEKELQPSEKIEKAQQAPEGQPRLDQGSGASAEDAAVQEERDAGVLSRVCGLLRQLHTAYSGLVSSLRGLPAELQQPVGRARHSLCELYGIVASAGSVEELPAERLVQSREGVHQAWQGLEQLLEGLQHNPPLSWLVGPFALPAGGQ

SEQ ID NO: 61 - protein, 399 aa, Homo sapiens
MKMRFLGLVVCLVLWPLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 62 - protein, 399 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 63 - protein, 399 aa, Homo sapiens; identical to SEQ ID NO: 61

SEQ ID NO: 64 - protein, 399 aa, Homo sapiens; identical to SEQ ID NO: 61

SEQ ID NO: 65 - protein, 398 aa, Homo sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 66 - protein, 232 aa, Homo sapiens
FRVILLDLRGFGESSPSDLAEYRFDDLAEDLEALLDALGLEKPVILVGHSMGGAIALAYAAKYPELRVKALVLVSPPLPAGLSSDLFPRQGNLEGLLLANFRNRLSRSVEALLGRALKQFFLLGRPLVSDFLKQAEDWLSSLIRQGEDDGGDGLLGAAVALGKLLQWDLSALKDIKVPTLVIWGTDDPLVPLDASEKLSALIPNAEVVVIDDAGHLALLEKPEEVAELIKFL

SEQ ID NO: 67 - protein, 3312 aa, Homo sapiens
MMARRPPWRGLGERSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 68 - protein, 3301 aa, Mus musculus
MARRPLWWGLPGPSTPVLLLLLLSLFPFSREELGGGGDQDWDPGVATTTGPRAQIGSGAVALCPESPGVWEDGDPGLGVREPVFMRLRVGRQNARNGRGAPEQPNAEVVVQALGSREQEAGQGPGYLLCWHPEISSCGRTGPLRRGSLPLDALSPGDSDLRNSSPHPSELLAQPDGSRPVAFQRNARRSIRKRVETSRCCGKLWEPGHKGQGERSATSTVERGPFRRDCLPGSLGSGLGEDSAPRAVRTAPTPGSAPRESRTAPGRMRSRGLFRRRFLFERPGPRPPGFPTGPEAKQILSTNQARPRRAANRHPQFPQYNYQTLVPENEAAGTSVLRVVAQDPDPGEAGRLIYSLAALMNSRSLELFSIDPQSGLIRTAAALDRESMERHYLRVTAQDHGSPRLSATTMVAVTVADRNDHAPVFEQAQYRETLRENVEEGYPILQLRATDGDAPPNANLRYRFVGSPAVRTAAAAAFEIDPRSGLISTSGRVDREHMESYELVVEASDQGQEPGPRSATVRVHITVLDENDNAPQFGEKRYVAQVREDVRPHTVVLRVTATDKDKDANGLVHYNIISGNSRGHFAIDSLTGEIQVMAPLDFEAEREYALRIRAQDAGRPPLSNNTGLASIQVVDINDHAPIFVSTPFQVSVLENAPLGHSVIHIQAVDADHGENSRLEYSLTGVASDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSMNEDRPVGSTVVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDDGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNRTSGELRLSRKLDNNRPLVASMLVTVTDGLHSVTAQCVLRVVIITEELLANSLTVRLENMWQERFLSPLLGHFLEGVAAVLATPTEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASTSTLFRPIQPIAGLRCRCPPGFTGDFCETELDLCYSNPCRNGGACARREGGYTCVCRPRFTDCELDTEAGRCVPGVCRNGGTCTNAPNGGFRCQCPAGGAFEGPRCEVAARSFPPSSFVMFRGLRQRFHLTLSLSFATVQPSGLLFYNGRLNEKHDFLALELVAGQVRLTYSTGESNTVVSPTVPGGLSDGQWHTVHLRYYNKPRTDALGGAQGPSKDKVAVLSVDDCNVAVALQFGAEIGNYSCAAAGVQTSSKKSLDLTGPLLLGGVPNLPENFPVSHKDFIGCMRDLHIDGRRMDMAAFVANNGTMAGCQAKSHFCASGPCKNNGFCSERWGGFSCDCPVGFGGKDCRLTMAHPYHFQGNGTLSWDFGNDMAVSVPWYLGLSFRTRATKGILMQVQLGPHSVLLCKLDRGLLSVTLNRASGHTVHLLLDQMTVSDGRWHDLRLELQEEPGGRRGHHIFMVSLDFTLFQDTMAMGGELQGLKVKQLHVGGLPPSSKEEGHQGLVGCIQGVWIGFTPFGSSALLPPSHRVNVEPGCTVTNPCASGPCPPHADCKDLWQTFSCTCRPGYYGPGCVDACLLNPCQNQGSCRHLQGAPHGYTCDCVSGYFGQHCEHRVDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEDQGWLEPDLFNCTSPAFRELSLLLDGLELNKTALDTVEAKKLAQRLREVTGQTDHYFSQDVRVTARLLAYLLAFESHQQGFGLTATQDAHFNENLLWAGSALLAPETGHLWAALGQRAPGGSPGSAGLVQHLEEYAATLARNMELTYLNPVGLVTPNIMLSIDRMEHPSSTQGARRYPRYHSNLFRGQDAWDPHTHVLLPSQASQPSPSEVLPTSSNAENATASSVVSPPAPLEPESEPGISIVILLVYRALGGLLPAQFQAERRGARLPQNPVMNSPVVSVAVFHGRNFLRGVLVSPINLEFRLLQTANRSKAICVQWDPPGPTDQHGMWTARDCELVHRNGSHARCRCSRTGTFGVLMDASPRERLEGDLELLAVFTHVVVAVSVTALVLTAAVLLSLRSLKSNVRGIHANVAAALGVAELLFLLGIHRTHNQLLCTAVAILLHYFFLSTFAWLLVQGLHLYRMQVEPRNVDRGAMRFYHALGWGVPAVLLGLAVGLDPEGYGNPDFCWISIHEPLIWSFAGPIVLVIVMNGTMFLLAARTSCSTGQREAKKTSVLTLRSSFLLLLLVSASWLFGLLAVNHSILAFHYLHAGLCGLQGLAVLLLFCVLNADARAAWTPACLGKKAAPEETRPAPGPGSGAYNNTALFEESGLIRITLGASTVSSVSSARSGRAQDQDSQRGRSYLRDNVLVRHGSTAEHTERSLQAHAGPTDLDVAMFHRDAGADSDSDSDLSLEEERSLSIPSSESEDNGRTRGRFQRPLRRAAQSERLLAHPKDVDGNDLLSYWPALGECEAAPCALQAWGSERRLGLDSNKDAANNNQPELALTSGDETSLGRAQRQRKGILKNRLQYPLVPQSRGTPELSWCRAATLGHRAVPAASYGRIYAGGGTGSLSQPASRYSSREQLDLLLRRQLSKERLEEVPVPAPVLHPLSRPGSQERLDTAPARLEARDRGSTLPRRQPPRDYPGTMAGRFGSRDALDLGAPREWLSTLPPPRRNRDLDPQHPPLPLSPQRQLSRDPLLPSRPLDSLSRISNSREGLDQVPSRHPSREALGPAPQLLRAREDPASGPSHGPSTEQLDILSSILASFNSSALSSVQSSSTPSGPHTTATASALGPSTPRSATSHSISELSPDSEVPRSEGHS

SEQ ID NO: 69 - protein, 3313 aa, Rattus norvegicus
MARRPLWWGLPGPSTPLLLLLLFSLFPSSREEMGGGGDQGWDPGVATATGPRAQIGSGAVALCPESPGVWEDGDPGLGVREPVFMKLRVGRQNARNGRGAPEQPNREPVVQALGSREQEAGQGSGYLLCWHPEISSCGRTGHLRRGSLPLDALSPGDSDLRNSSPHPSELLAQPDSPRPVAFQRNGRRSIRKRVETFRCCGKLWEPGHKGQGERSATSTVDRGPLRRDCLPGSLGSGLGEDSAPRAVRTAPAPGSAPHESRTAPERMRSRGLFRRGFLFERPGPRPPGFPTGAEAKRILSTNQARSRRAANRHPQFPQYNYQTLVPENEAAGTAVLRVVAQDPDPGEAGRLVYSLAALMNSRSLELFSIDPQSGLIRTAAALDRESMERHYLRVTAQDHGSPRLSATTMVAVTVADRNDHAPVFEQAQYRETLRENVEEGYPILQLRATDGDAPPNANLRYRFVGSPAARTAAAAAFEIDPRSGLISTSGRVDREHMESYELVVEASDQGQEPGPRSATVRVHITVLDENDNAPQFSEKRYVAQVREDVRPHTVVLRVTATDKDKDANGLVHYNIISGNSRGHFAIDSLTGEIQVMAPLDFEAEREYALRIRAQDAGRPPLSNNTGLASIQVVDINDHSPIFVSTPFQVSVLENAPLGHSVIHIQAVDADHGENSRLEYSLTGVASDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGMGLVTLALPLDYKQERYFKLVLTASDRALHDHCYVHINITDANTHRPVFQSAHYSVSMNEDRPVGSTVVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDDGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGHFLEGVAAVLATPTEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTNAPNGGFRCQCPAGGAFEGPRCEVAARSFPPSSFVMFRGLRQRFHLTLSLSFATVQPSGLLFYNGRLNEKHDFLALELVAGQVRLTYSTGESSTVVSPTVPGGLSDGQWHTVHLRYYNKPRTDALGGAQGPSKDKVAVLSVDDCNVAVALRFGAEIGNYSCAAAGVQTSSKKSLDLTGPLLLGGVPNLPENFPVSRKDFIGCMRDLHIDGRRVDMAAFVANNGTTAGCQAKSHFCASGPCKNGGLCSERWGGFSCDCPVGFGGKDCRLTMAHPYHFQGNGTLSWDFGNDMPVSVPWYLGLSFRTRATKGVLMQVQLGPHSVLLCKLDQGLLSVTLSRASGHAVHLLLDQMTVSDGRWHDLRLELQEEPGGRRGHHIFMVSLDFTLFQDTMAMGSELEGLKVKHLHVGGPPPSSKEEGPQGLVGCIQGVWTGFTPFGSSALPPPSHRINVEPGCTVTNPCASGPCPPHANCKDLWQTFSCTCWPGYYGPGCVDACLLNPCQNQGSCRHLQGGPHGYTCDCASGYFGQHCEHRMDQQCPRGWWGSPTCGPCNCDVHKGFDPNCNKTSGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGLRGTGAAVRLCDEDHGWLEPDFFNCTSPAFRELSLLLDGLELNKTALDTVEAKKLAQRLREVTGQTDHYFSQDVRVTARLLAYLLAFESHQQGFGLTATQDAHFNENLLWAGSALLAPETGDLWAALGQRAPGGSPGSAGLVRHLEEYAATLARNMDLTYLNPVGLVTPNIMLSIDRMEQPSSSQGAHRYPRYHSNLFRGQDAWDPHTHVLLPSQSPQPSPSEVLPTSSNAENATASGVVSPPAPLEPESEPGISIVILLVYRALGGLLPAQFQAERRGARLPQNPVMNSPVVSVAVFRGRNFLRGALVSPINLEFRLLQTANRSKAICVQWDPPGPADQHGMWTARDCELVHRNGSHARCRCSRTGTFGVLMDASPRERLEGDLELLAVFTHVVVAASVTALVLTAAVLLSLRSLKSNVRGIHANVAAALGVAELLFLLGIHRTHNQLLCTVVAILLHYFFLSTFAWLLVQGLHLYRMQVEPRNVDRGAMRFYHALGWGVPAVLLGLAVGLDPEGYGNPDFCWISIHEPLIWSFAGPIVLVIVMNGIMFLLAARTSCSTGQREAKKTSVLRTLRSSFLLLLLVSASWLFGLLAVNHSVLAFHYLHAGLCGLQGLAVLLLFCVLNADARAAWTPACLGKKAAPEETRPAPGPGSGAYNNTALFEESGLIRITLGASTVSSVSSARSGRAQDQDSQRGRSYLRDNVLVRHGSTAEHAEHSLQAHAGPTDLDVAMFHRDAGADSDSDSDLSLEEERSLSIPSSESEDNGRTRGRFQRPLRRAAQSERLLAHPKDVDGNDLLSYWPALGECEAAPCALQAWGSERRLGLDSNKDAANNNQPELALTSGDETSLGRAQRQRKGILKNRLQYPLVPQTRGTPELSWCRAATLGHRAVPAASYGRIYAGGGTGSLSQPASRYSSREQLDLLLRRQLSRERLEEVPVPAPVLHPLSRPGSQERLDTAPARLEPRDRGSTLPRRQPPRDYPGTMAGRFGSRDALDLGAPREWLSTLPPPRRNRDLDPQHPPLPLSPQRPLSRDPLLPSRPLDSLSRISNSRERLDQVPSRHPSREALGPAPQLLRAREDPASGPSHGPSTEQLDILSSILASFNSSALSSVQSSSTPSGPHTTATPSATASALGPSTPRSATSHSISELSPDSEVPRSEGHS

SEQ ID NO: 70 - protein, 2923 aa, Homo sapiens
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 71 - protein, 2920 aa, Mus musculus
MRTRAASAPLPTPLLPLLLLLLLLPPSPLLGDQVGPCRSLGSGGRSSSGACAPVGWLCPASASNLWLYTSRCRESGIELTGHLVPHHDGLRVWCPESGAHIPLPPSSEGCPWSCRLLGIGGHLSPQGTLTLPEEHPCLKAPRLRCQSCKLAQAPGLRAGEGSPEESLGGRRKRNVNTAPQFQPPSYQATVPENQPAGTSVASLRAIDPDEGEAGRLEYTMDALFDSRSNHFFSLDPITGVVTTAEELDRETKSTHVFRVTAQDHGMPRRSALATLTILVTDTNDHDPVFEQQEYKESLRENLEVGYEVLTVRATDGDAPPNANILYRLLEGAGDSPSDAFEIDPRSGVIRTRGPVDREEVESYKLTVEASDQGRDPGPRSSTAIVFLSVEDDNDNAPQFSEKRYVVQVREDVTPGAPVLRVTASDRDKGSNALVHYSIMSGNARGQFYLDAQTGALDVVSPLDYETTKEYTLRIRAQDGGRPPLSNVSGLVTVQVLDINDIRPPIFVSTPFQATVLESVPLGYLVLHVQAIDADAGDNARLEYSLAGVGHDFPFTINNGTGWISVAAELDREEVDFYSFGVEARDHGTPALTASASVSVTILDVNDNNPTFTQPEYTVRLNEDAAVGTSVVTVSAVDRHAHSVITYQITSGNTRNRFSITSQSGGGLVSLALPLDYKLERQYVLAVTASDGTRQDTAQIVVNVTDANTHRPVFQSSHYTVNGNEDRPAGTTVVLISATDEDTGENARITYFMEDSIPQFRIDGDTGAVTTQAELDYEDQVSYTLAITARDNGIPQKSDTTYLEILVNDVNDNAPQFLRDSYQGTVYEDVPPFTSVLQILATDRDSGLNGRVFYTFQGGDDGDGDFIVESTSGIVRTLRRLDRENVAQYVLRAYAVDKGMPPARTPMEVTVTVLDGNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELRLSRALDNNRPLEAIMSVLVSDGVHSVTAQCSLRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAKRVLPFDRQHLLREPCENYMRCVSVLRFDSSAPFIASSSVLFRPIHLVGGLRCRCPPGLTGDYCETEVDLCYSRTCGPHGRCRSREGGYTCLCRGCYTGEHCEASTHSGRCTPGVCKNGGTCVNLLVGGIKCDCPSGHFEKPFCQVTTRSFPARPFITFRGLHQRFHFTLALSFATKERNGLLLYNGRFNEKHDFVALEVIQEQVQLTFSAGESTTTVSPFVPGGVSDGQWHTVQLKYYNKPLLGQTGLPQGPSEQKVAVVSVDGCDTGVALRFGAMLGNYSCAAQGTQGGSKKSLDLTGPLLLGGVPDLPESFPVRMRHFVGCMKDLQVDSRHIDMADFIANNGTVPGCPTKKIVCDSSICHNGGTCVNQWNTFSCECPLGFGGKSCAQEMANPQRFLGSSLVAWHGLYLPISQPWHLNLMFRTRQADGVLLQAVTRGRSTITLQLRAGHVRLSMEGTGLQASSLHLEPGRANDGDWHHAQLALGASRGPGHAILSFNYGQQTAEGNLGPRLHGLHLSNITVGGVPGPASGVARGFRGCLQGVRVSETPEGVHSLDPSRGESINVEPGCSLPDPCDSNPCPTNSYYSNDWNSYSCSCVLGYYGDNCTNVCDLNPCEHQSVCTRKPNTPHGYICECLPNYLGPYCETRIDQPCPRGWWGHPTCGPCNCDVSKGFDPDCNKTSGECHCKEKHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSVTFSELKGFAERLQRNESGLDSGRSQRLALLLRNATQHTSGYFGSDVKVAYQLATRLLAHESAQRGFGLSATQDVHFTENLLRVGSALLDAANKRHWELIQQTEGGTAWLLQHYEAYASALAQNMRHTYLSPFTIVTPNIVISVVRLDKGNFAGTKLPRYEALRGERPPDVETTVILPESVFREMPSMVRSAGPGEAQETEELARRQRRHPELSQGEAVASVIIYHTLAGLLPHNYDPDKRSLRVPKRPVINTPAVSISVHDDEELLPRALDKPVTVQFRLLETEERTKPICVFWNHSILVSGTGGWSARGCEVVFRNESHVSCQCNHMTSFAVLMDMSRRENGEILPLKTLTYVALGVTLAALMLTFLFLTLLRALRSNQHGIRRNLTAALGLAQLVFLLGINQADLPFACTVIAILLHFLYLCTFSWALLEALHLYRALTEVRDVNASPMRFYYMLGWGVPAFITGLAVGLDPEGYGNPDFCWLSVYDTLIWSFAGPVAFAVSMRVFLYILSARASCAAQRQGFEKKGPVSGLRSSFTVLLLLSATWLLALLSVNSDTLLFHYLFAACNCVQGPFIFLSYVVLSKEVRKALKFACSRKPSPDPALTTKYTLTSSYNCPSPYADGRLYQPYGDSAGSLHSASRSGKSQPSYIPFLLREESTLNPGQVPPGLGDPSGLFLEGQAQQHDPDTDSDSDLSLEDDQSGSYASTHSSDSEEEEEEAAFPGEQGWDSCLGPGAERLPLHSTPKDGGPGSGKVPWLGDFGTTTKENSGSGALEERPRENGDALTREGSLGPLPGPSTQPHKGILKKKCLPTISEKSSLLRLPLEQGTGSSRGSSISEGSRHGPPPRPPPRQSLQEQLNGVMPVAMSINAGTVDEDSSGSEFLFFNFLH

SEQ ID NO: 72 - protein, 107 aa, Homo sapiens
YSASVPENAPVGTEVLTVTATDADDPLGPNGRIRYSILGGNPGGWFRIDPDTGDNEGIISTTKPLDREEIFNGEYELTVEATDADPLSAAGGSPPLSGTATVTITVL

SEQ ID NO: 73 - protein, 107 aa, Homo sapiens; identical to SEQ ID NO: 72

SEQ ID NO: 74 - protein, 107 aa, Homo sapiens; identical to SEQ ID NO: 72

SEQ ID NO: 75 - protein, 107 aa, Homo sapiens; identical to SEQ ID NO: 72

SEQ ID NO: 76 - protein, 107 aa, Homo sapiens; identical to SEQ ID NO: 72

SEQ ID NO: 77 - protein, 107 aa, Homo sapiens; identical to SEQ ID NO: 72

SEQ ID NO: 78 - protein, 107 aa, Homo sapiens; identical to SEQ ID NO: 72

SEQ ID NO: 79 - protein, 107 aa, Homo sapiens; identical to SEQ ID NO: 72

SEQ ID NO: 80 - protein, 45 aa, Homo sapiens
CAPNNPCSNGGTCVNTPGGSSDNFGGYTCECPPGDYYLSYTGKRC

SEQ ID NO: 81 - protein, 45 aa, Homo sapiens; identical to SEQ ID NO: 80

SEQ ID NO: 82 - protein, 77 aa, Homo sapiens
FRTTEPSGLLLLGYGGTNTDRGGKKEIGDDFLALELVDGRLEVSYDLGSGHRLRPAVVRSGDRVLNDGKWHRVELER

SEQ ID NO: 83 - protein, 45 aa, Homo sapiens; identical to SEQ ID NO: 80

SEQ ID NO: 84 - protein, 161 aa, Homo sapiens
FRTTEPSGLLLLGYGGTNTDRGGKKEIGDDFLALELVDGRLEVSYDLGSGHRLRPAVVRSGDRVLNDGKWHRVELERNGRKGTLSVDGEEPSKKTLSETVVDGESPSGPDVTSENLDLDTPPILYVGGLPEQKSVKRRLAAISTSFKGCIRDVSINGKPLD

SEQ ID NO: 85 - protein, 45 aa, Homo sapiens; identical to SEQ ID NO: 80

SEQ ID NO: 86 - protein, 45 aa, Homo sapiens; identical to SEQ ID NO: 80

SEQ ID NO: 87 - protein, 79 aa, Homo sapiens
GLYCPATWDGILCWPRTPAGTLVVVPCPDYFSGFNYDTTGEDFSNGNASRNCTENGWWERHPNSNWPWPDYTNCTSPEY

SEQ ID NO: 88 - protein, 54 aa, Homo sapiens
SNPICVFWDESELSLGVWSTDRGCELVETSKPSHTTCSCNHLTSFAVLMDVSPN

SEQ ID NO: 89 - protein, 273 aa, Homo sapiens
ALLLKVIYTVGYSLSSLVCLLLAIAIFLLFRKLRCTRNYIHMNLFLSFILRALSFLIGDAVLLNSGCKVVAVFLHYFFLANFFWMLVEGLYLYTLLVVTVEVFFSERKRLWWYLLIGWGVPAVFVTIWAIVRPDKYGPILAEGPAGYGNEGCCWLSNDTNSGFWWIIKGPILLIILVNFIFFINILRILVQKLRIDSLSPQTGETDQYRKKRLVKSTLLLLPLLGVTWILFLFAPEDQSQGTLSLVFLYLFLILNSFQGFFVAVLYCFLNGEV

SEQ ID NO: 90 - protein, 328 aa, Homo sapiens
LGLLRLGFLVEFLSRAVISGFMAGAAILILLSQLKGLLGLSNLFTRHSGIVSVLRALFDLVDNLHDFLKWNWATLVIGISFLIFLLIIKLLPNPKKRKKKLFWVPAPAPLVAVILATLISYLFNRHKLADRYGVSIVGEIPSGLPPPSLPRLNLSPSTLLDLLPIALALALVGLLESILTAKSFAKIKGYKIDSNKELVAQGIANIVGSLFGGYPATGSFSRSAVNVKAGAKTQLSGIVMAVVVLLVLLFLTPLLEYIPMAVLAAIIIVALIGMLIDWSELIRLLWKLSKLDFLIWLATFFGTVFVDNLEIGVLVGVAISLLFLILRV

SEQ ID NO: 91 - protein, 116 aa, Homo sapiens
YIEAETIPGIEVLILRLSGPLDFANAELKERLLRAIAEGPERKKIELRHVILDLSAVSFIDSSGLGALLELYKELKKRGVELVLVGPSPEVRRTLELTGLDDLIGKEKIFPTVAEA

SEQ ID NO: 92 - protein, 461 aa, Homo sapiens [sequence omitted]

SEQ ID NO: 93 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 94 - protein, 461 aa, Pan troglodytes
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVDTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 95 - protein, 456 aa, Homo sapiens
MIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 96 - protein, 456 aa, Homo sapiens
MIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGTCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGLHEGARDSCQGDSGGPHVTEVEGTSFLTGIISWGEECAMKGKYGIYTKVSRYVNWIKEKTKLT

SEQ ID NO: 97 - protein, 42 aa, Homo sapiens
LEELRKGNLERECLEEVCELEEAREIFEDTEGTQEFWRKYYD

SEQ ID NO: 98 - protein, 45 aa, Homo sapiens; identical to SEQ ID NO: 80

SEQ ID NO: 99 - protein, 56 aa, Homo sapiens
CPSGQVEVNGECVKKVAIGETGCLASEQCPGRWPGSQCIDGMCQCPEGFTAVNGVC

SEQ ID NO: 100 - protein, 259 aa, Homo sapiens
IVGGREAQPGSFGSPWQVSLQVRSGGGSRKHFCGGSLISENWVLTAAHCVSGAASAPASSVRVSLSVRLGEHNLSLTEGTEQKFDVKKTIIVHPNYNPDTLDNGAYDNDIALLKLKSPGVTLGDTVRPICLPSASSDLPVGTTCTVSGWGRRPTKNLGLSDTLQEVVVPVVSRETCRSAYEYGGTDDKVEFVTDNMICAGALGGKDACQGDSGGPLVCSDGNRDGRWELVGIVSWGSYGCARGNKPGVYTRVSSYLDWI

SEQ ID NO: 101 - protein, 312 aa, Homo sapiens
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 102 - protein, 312 aa, Bos taurus
MRLLLALLVLAAAPPQARAASHWCYQIQVKPSNYTCLEPDEWEGSCQNNRQSPVNIVTAKTQLDPNLGRFSFSGYNMKHQWVVQNNGHTVMVLLENKPSIAGGGLSTRYQATQLHLHWSRAMDRGSEHSFDGERFAMEMHIVHEKEKGLSGNASQNQFAEDEIAVLAFMVEDGSKNVNFQPLVEALSDIPRPNMNTTMKEGVSLFDLLPEEESLRHYFRYLGSLTTPTCDEKVVWTVFQKPIQLHRDQILAFSQKLFYDDQQKVNMTDNVRPVQSLGQRQVFRSGAPGLLLAQPLPTLLAPVLACLTVGFLR

SEQ ID NO: 103 - protein, 308 aa, Oryctolagus cuniculus
MQLLFALLALGALRPLAGEELHWCYEIQASNYSCLGPDKWQEDCQKSRQSPINIVTTKAEVDHSLGRFHFSGYDQREARLVENNGHSVMVSLGDEISISGGGLPARYRATQLHLHWSQELDRGSEHSLDGERSAMEMHIVHQKETGTSGNEVQDSDDSIAVLAFLVEAGPTMNEGFQPLVTALSAISIPGTNTTMAPSSLWDLLPAEEELRHYFRYMGSLTTPACSETVVWTVFQEPIRLHRDQILEFSSKLYYDQERKMNMKDNVRPLQRLGDRSVFKSQAAGQLLPLPLPTLLVPTLACVMAGLLR

SEQ ID NO: 104 - protein, 309 aa, Rattus norvegicus
MQLLLALLALAYVAPSTEDSHWCYEIQAKEPNSHCSGPEQWTGDCKKNQQSPINIVTSKTKLNPSLTPFTFVGYDQKKKWEVKNNQHSVEMSLGEDIYIFGGDLPTQYKAIQLHLHWSEESNKGSEHSIDGKHFAMEMHVVHKKMTTGDKVQDSDSKDKIAVLAFMVEVGNEVNEGFQPLVEALSRLSKPFTNSTVSESCLQDMLPEKKKLSAYFRYQGSLTTPGCDETVIWTVFEEPIKIHKDQFLEFSKKLYYDQEQKLNMKDNVRPLQPLGNRQVFRSHASGRLLSLPLPTLLVPTLTCLVASFLH

SEQ ID NO: 105 - protein, 305 aa, Mus musculus
MQLLLALLALAYVAPSTEDSGWCYEIQTKDPRSSCLGPEKWPGACKENQQSPINIVTARTKVNPRLTPFILVGYDQKQQWPIKNNQHTVEMTLGGGACIIGGDLPARYEAVQLHLHWSNGNDNGSEHSIDGRHFAMEMHIVHKKLTSSKEDSKDKFAVLAFMIEVGDKVNKGFQPLVEALPSISKPHSTSTVRESSLQDMLPPSTKMYTYFRYNGSLTTPNCDETVIWTVYKQPIKIHKNQFLEFSKNLYYDEDQKLNMKDNVRPLQPLGKRQVFKSHAPGQLLSLPLPTLLVPTLTCLVANFLQ

SEQ ID NO: 106 - protein, 170 aa, Homo sapiens
WGYGEHNGPEHSNNAHVLWHKLYPIANGGNCQGERQSPINIQTKEAKYDPSLKPLSLSYDAATAKEFEIVNNGHSFQVEFDDSDDKSVLSGGPLPAGHPYRLKQFHFHWGGASSDDQGSEHTVDGKKYAAELHLVHWNSTKYGSYKEAVSKPDGLAVLGVFLKVGDYQEN

SEQ ID NO: 107 - protein, 121 aa, Homo sapiens
KVGDYQENPGLQKVVDALSSIKTKGKSATFTNFDPSTLLPSEKLRDYWTYPGSLTTPPLTESVTWIVLKEPISVSSEQLLKFRSLLFNAEGEEEVPGCDGIMVDNYRPTQPLKGRVVRASF

SEQ ID NO: 108 - protein, 779 aa, Homo sapiens
GMKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 109 - protein, 571 aa, Homo sapiens
MNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMGPRPPGSPPEAALSAQVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 110 - protein, 605 aa, Homo sapiens
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIERPRIRGRLNTSYSD

SEQ ID NO: 111 - protein, 410 aa, Homo sapiens
MVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 112 - protein, 392 aa, Mus musculus
MWAPHLVVAYLIFVTLALALPGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEETRIDGGPVILLQAGTPYNLTCRAFNAKPAATIIWFRDGTQQEGAVTSTELLKDGKRETTISQLLIEPTDLDIGRVFTCRSMNEAIPNGKETSIELDVHHPPTVTLSIEPQTVLEGERVIFTCQATANPEILGYRWAKGGFLIEDAHESRYETNVDYSFFTEPVSCEVYNKVGSTNVSTLVNVHFAPRIVVYPKPTTTDIGSDVTLTCVWVGNPPLTLTWTKKDSNMVLSNSNQLLLKSVTQADAGTYTAGPSCLGSEWLSERYRFM

SEQ ID NO: 113 - protein, 45 aa, Homo sapiens
GESVTLTCSVSGFGPPPVTWLRNGKLSLTISVTPEDSGGTYTCVV

SEQ ID NO: 114 - protein, 736 aa, Homo sapiens
MGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 115 - protein, 613 aa, Homo sapiens
MSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 116 - protein, 745 aa, Cricetulus griseus
GLQDDQDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSSADAQHWVQGLRKIIHHSGSMDQRQKLQHWIHSCLRKADKNKDNKMNFKELKDFLKELNIQVDDSYARKIFRECDHSQTDSLEDEEIETFYKMLTQRAEIDRVFAEAAGSAETLSVEKLVTFLQHQQREEAAGPALALSLIERYEPSETAKAQRQMTKDGFLMYLLSADGSAFSLAHRRVYQDMDQPLSHYLVSSSHNTYLLEDQLTGPSSTEAYIRALCKGCRCLELDCWDGPNQEPIIYHGYTFTSKILFYDVLRAIRDYAFKASPYPVILSLENHCSLEQQQVMARHLKAILGPMLLDQPLDGVTMSLPSPEQLKGKILLKGKKFGGLLPAGGENGPETTDVSDEDEAAEMEDEAVRSQVQQKSKEDKLNVAPELSDMVIYCKSVHFGGFSNPSTSGQAFYEMASFSENRALRLLQESGNNFVRHNVSHLSRIYPAGRRTDSSNYSPVEMWNGGCQIVALNFQTPGPEMDVYLGRFQDNGACGYVLKPAFLRDPDTAFNPRALTQGPWWAQKRLRVRVISGQQLPKVNKSKNSIVDPKVIVEVHGVGQDVASRQTAVITNNGFNPWWDTEFEFEVAVPDLALVRFVVEDYDASSKNDFIGQSTIPWNSLKQGYRHVHLLSKNGDQHPSATLFVKISLQD

SEQ ID NO: 117 - protein, 756 aa, Mus musculus
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADVQHWVQGLRKIIDRSGSMDQRQKLQHWIHSCLRKADKNKDNKMNFKEVKDFLKELNVQVDDSYARKIFRECDHSQTDSLEDEEIETFYRMLTQRAEIDRAFAEAAGSAETLSVEKLVTFLQHQQREEEAGPALALSLIERYEPSETAKAQRQMTKDGFLMYLLSADGNAFSLAHRRVYQDMNQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMAHHLRAILGPMLLDQPLDGVTTSLPSPEQLKEKILLKGKKLGGLLPAGGENGPEATDVSDEDEAAEMEDEAVRSQVQHKPKEDKLKLVPELSDMVIYCKSVHFGGFSSPSTSGQAFYEMASFSESRALRLLQESGNSFVRHNVGHLSRIYPAGWRTDSSNYSPVEMWNGGCQIVALNFQTPGPEMDVYLGCFQDNGGCGYVLKPAFLRDPDTTFNSRALTQGPWWAPKKLRVWIISGQQLPKVNKNKNSIVDPKVIVEIHGVGQDVASRQTAVITNNGFNPRWDTEFEFVVAVPDLALVRFMVEDYDSSSKNDFIGQSTIPWNSLKQGYRHVHLLSKNGDLHPSATLFVKISIQD

SEQ ID NO: 118 - protein, 756 aa, Homo sapiens
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGPGETLSVDQLVTFLQHQQREEAAGPALALSLIERYEPSETTKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQDRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 119 - protein, 153 aa, Homo sapiens
DMSIPLSHYFISSSHNTYLTGKQLWGKSSVESYRQQLDAGCRCVELDCWDGKPDDEPIIYHGHTLTLEIKLKDVLEAIKDFAFKPTSPYPVILSLENHCNSDDQQRKMAKYFKEIFGDMLLTKPTLDSLTTEPGLPLPSLKDLRGKILLKNKK

SEQ ID NO: 120 - protein, 87 aa, Homo sapiens
KLLKESPVEFVKYNKRQLSRVYPKGTRVDSSNFMPQVFWNAGCQMVALNFQTSDLPMQINDGMFEYNGGQPDGSFKSGYLLKPEFLR

SEQ ID NO: 121 - protein, 95 aa, Homo sapiens
LTVTVIEARNLPKMDKVNGRLSDPYVKVSLLGDKKDLKKFKTKVVKKTNGLNPVWNEETFVFEKVPLPELASKTLRFAVYDEDRFSRDDFIGQVT

SEQ ID NO: 122 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 123 - protein, 323 aa, Homo sapiens [sequence omitted]

SEQ ID NO: 124 - protein, 323 aa, Homo sapiens
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 125 - protein, 329 aa, Homo sapiens [sequence omitted]

SEQ ID NO: 126 - protein, 323 aa, Macaca fuscata
MDSKHQCVKLNDGHFMPVLGFGTYAPAEVPKNKAIEATKLAIEAGFRHIDSAHLYNNEEYVGLAIRSKIADGTVKREDIFYTSKLWCNSHRPEFVRPALERSLKNLQLDYVDLYLIHFPVSLKPGEELIPKDENGKLLFDTVDLCATWEAMEKCKDAGLAKSIGVSNFNRRQLEMILNKPGLKYKPVCNQVECHPYLNQRKLLDFCKSKDIVLVAYSALGSHREKPWVDQNSPVLLEDPVLCALAKKHKRTPALIALRYQLQRGVVVLAKSYNEQRIRENMKVFEFQLTSEDMKAIDGLDRNIRYLTLDIFAGPPNYPFSDEY

SEQ ID NO: 127 - protein, 368 aa, Homo sapiens
LNNGLKLKMPLLGLGTWQTPGEEDYLWGRVDKEEAKEAVKAALDAGYRHIDTAAIYGNGQKPGQSEEEVGEAIKEALEEGSVVVITKYKREDIFITSDKLWNTFGPDLSEYGHSPKHVREALEKSLKRLGLDYVDLYLIHWPDPFKPGIEDKYPLGFPTDDDGKLIYEDVPIEETWKALEKLVDEGKVRSIGVSNFSAEQLEELLSYAGKLKLIPPVVNQVELHPYLRQDELRKVPLLPFCKSHGIAVTAYSPLGSGLLTGKYKTEEDIPGDRRSLLGADKGWSELGSPELLEDPVLKAIAEKYGYKDKTPAQVALRWALQRGGGAGVVVVIPKSSNPERIKENLKAFDDFELTEEDMKAIDELDRGK

SEQ ID NO: 128 - protein, 255 aa, Staphylococcus aureus
MTMMDMNFKYCHKIMKKHSKSFSYAFDLLPEDQRKAVWAIYAVCRKIDDSIDVYGDIQFLIQIKEDIQSIEKYPYEHHHFQSDRRIMMALQHVAQHKNIAFQSFYNLIDTVYKDQHFTMFETDAELFGYCYGVAGTVSEVLTPILSDHETHQTYDVARRLGESLQLINILRDVGEDFDNERIYFSKQRLKQYEVDIAEVYQNGVNNHYIDLWEYYAAIAEKDFQDVMDQIKVFSIEASPIIELAARIYIEILGRS

SEQ ID NO: 129 - protein, 254 aa, Staphylococcus aureus
MTMMDMNFKYCHKIMKKHSKSFSYAFDLLPEDQRKAVWAIYAVCRKIDDSIDVYGDIQFLIQIKEDIQSIEKYPYEHHHFQSDRRIMMALQHVAQHKNIAFQSFYNLIDTVYKVNILQCLKRTLELFGYCYGVAGRRSSIDADFSDHETHQTYDVARRLGESLQLINILRDVGEDFDNERIYFSKQRLKQYEVDIAEVYQNGVNNHYIDLWEYYAAIAEKDFQDVMDQIKVFSIEASPIIELAARIYIEILGRS

SEQ ID NO: 130 - protein, 436 aa, Staphylococcus aureus
MSVTLLWVVSPNSQLSNCFGFVDSVREENRLFYSSRFLYQHQTRTAVFNSRPKQFNNSNKQRRNSYPLDTDLRHPCSSGIDLPEISCMVASTAGEVAMSSEEMVYNVVLKQAALVNKQPSGVTRDLDVNPDIALPGTLSLLSEAYDRCGEVCAEYAKTFYLGTLLMTSERRRAIWAIYVWCRRTDELVDGPNASHITPTALDRWESRLEDLFRGRPFDMLDAALSDTVTKFPVDIQPFRDMIEGMRMDLRKSRYKNFDELYLYCYYVAGTVGLMSVPVMGIAPDSQATTESVYNAALALGIANQLTNILRDVGEDARRGRVYLPQDELAQAGLSDDDIFAGEVTIKWRNFMKNQIKRARMFFDMAENGVTELSEASRWPVWASLLLYRQILDEIEANDYNNFTKRAYVSKAKKIAALPIAYAKSLLRPSRIYTSKA

SEQ ID NO: 131 - protein, 410 aa, Citrus unshiu
MAIILVRAASPGLSAADSISHQGTLQCSTLLKTKRPAARRWMPCSLLGLHPWEAGRPSPAVYSSLPVNPAGEAVVSSEQKVYDVVLKQAALLKRQLRTPVLDARPQDMDMPRNGLKEAYDRCGEICEEYAKTFYLGTMLMTEERRRAIWAIYVWCRRTDELVDGPNANYITPTALDRWEKRLEDLFTGRPYDMLDAALSDTISRFPIDIQPFRDMIEGMRSDLRKTRYNNFDELYMYCYYVAGTVGLMSVPVMGIATESKATTESVYSAALALGIANQLTNILRDVGEDARRGRIYLPQDELAQAGLSDEDIFKGVVTNRWRNFMKRQIKRARMFFEEAERGVNELSQASRWPVWASLLLYRQILDEIEANDYNNFTKRAYVGKGKKLLALPVAYGKSLLLPCSLRNGQT

SEQ ID NO: 132 - protein, 38 aa, Homo sapiens
LAQGSKSFALAIRLLPPELRRAVLALYLWCRAADDVVD

SEQ ID NO: 133 - protein, 225 aa, Homo sapiens
DAPVDRAFAPCAYQALDVLEEFDIPREPFRDLIEDITKRMGAGMAMDLEKREKNLQYRYATFEDLLRYCYYVAGTVGLMMARLMGVRKLEDPADWQLEEVLDLRACDLGLALQLTNIARDVGEDARRGPCRVYLPTEWLSQYGLSLEDLLAPENTDKRIRRVLRRLLDNARAYYEDALTGLAGLPPQSRFPIAAAPQVYAGIGDAIEANGYDVFRRRAKTRKGEK

SEQ ID NO: 134 - protein, 661 aa, Homo sapiens
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTVFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 135 - protein, 661 aa, Mus musculus
MAPDISCFFLVALFLASCRATTSSDQKCIEKEVNKTYNCENLGLNEIPGTLPNSTECLEFSFNVLPTIQNTTFSRLINLTFLDLTRCQIYWIHEDTFQSQHRLDTLVLTANPLIFMAETALSGPKALKHLFFIQTGISSIDFIPLHNQKTLESLYLGSNHISSIKLPKGFPTEKLKVLDFQNNAIHYLSKEDMSSLQQATNLSLNLNGNDIAGIEPGAFDSAVFQSLNFGGTQNLLVIFKGLKNSTIQSLWLGTFEDMDDEDISPAVFEGLCEMSVESINLQKHYFFNISSNTFHCFSGLQELDLTATHLSELPSGLVGLSTLKKLVLSANKFENLCQISASNFPSLTHLSIKGNTKRLELGTGCLENLENLRELDLSHDDIETSDCCNLQLRNLSHLQSLNLSYNEPLSLKTEAFKECPQLELLDLAFTRLKVKDAQSPFQNLHLLKVLNLSHSLLDISSEQLFDGLPALQHLNLQGNHFPKGNIQKTNSLQTLGRLEILVLSFCDLSSIDQHAFTSLKMMNHVDLSHNRLTSSSIEALSHLKGIYLNLASNHISIILPSLLPILSQQRTINLRQNPLDCTCSNIYFLEWYKENMQKLEDTEDTLCENPPLLRGVRLSDVTLSCSMAAVGIFFLIVFLLVFAILLIFAVKYFLRWKYQHI

SEQ ID NO: 136 - protein, 25 aa, Homo sapiens
NLEELDLSNNNLSGSLPPESFGNLP

SEQ ID NO: 137 - protein, 25 aa, Homo sapiens
NLEELDLSNNNLSGSLPPESFGNLP

SEQ ID NO: 138 - protein, 25 aa, Homo sapiens
NLEELDLSNNNLSGSLPPESFGNLP

SEQ ID NO: 139 - protein, 25 aa, Homo sapiens
NLEELDLSNNNLSGSLPPESFGNLP

SEQ ID NO: 140 - protein, 54 aa, Homo sapiens
NPFNCDCELRWLLRWLRETNPRRLEDQEDLRCASPESLRGQPLLELLPSDFSCP

SEQ ID NO: 141 - protein, 330 aa, Homo sapiens; identical to SEQ ID NO: 20

SEQ ID NO: 142 - protein, 357 aa, Gallus gallus
MPAHLLQEEEFSSASSTTTVTSRVTKNGNVIMEKDLLNHDDVAAERGMVDDLFDETYREKEGPKPPLRYVWRNIILMSLLHLGAIIGLTLIPSAKIQTLAWAILCFVLSALGITAGSHRLWSHRSYKATLPLRIFLTIANSMAFQNDIYEWARDHRVHHKFSETHADPHNAMRGYFFSHMAWLLVRKHPDVIEKGQKLDLSDLKADKVVMFQRRYYKPSVVLLCFTLPTLVPWYFWDESIIISFFIPAILRYTLGLNATWLVNSAAHMFGNRPYDQNINPRENPLVSVGALGEGFHNYHHTFPYDYSTSEFGWRFNLTTAFIDLMCLLGLASDRKKVSKEVILARKMRTGDGSHKSG

SEQ ID NO: 143 - protein, 324 aa, Ctenopharyngodon idella
MPDMDIKAQARRAETVEDVFDHTYKEKEGPKPPIVVVWRNVILMTLLHTGALYGLLLIPSASFLTLIWTFACFVYSALGITAGAHRLWSHRSYKASLPLRIFLAFANSMAFQNDIYEWSRDHRVHHKYSETDADPHNAVRGFFFAHIGWLLVRKHPDVIEKGRKLEISDLKADKVVMFQRRHYKPSVLLMCFFVPMFVPWFFWGETLWVAYFVPTVLRYTLVLNATWLVNSAAHMWGNRPYDSTINPRENRFVTFSAIGEGFHNYHHTFPFDYSTSEYGWKLNLTTCFIDLMCFLGLASDPKRVSREAVLARVQRTGDGSHRSG

SEQ ID NO: 144 - protein, 327 aa, Cyprinus carpio
MPDREIKSPIWHPEPGTVEDVFDHTYKEKEGPKPPTVIVWRNVILMSLLHLGALYGLFLFPSARALTWIWFFGCLLFSALGITAGAHRLWSHRSYKASLPLQIFLALGNSMAFQNDIYEWSRDHRVHHKYSETDADPHNAVRGFFFSHVGWLLVRKHPDVIEKGRKLELSDLKADKVVMFQRRFYKPSVLLMCFFVPTFVPWYVWGESLWVAYFVPALLRYALVLNATWLVNSAAHMWGNRPYDSSINPRENRFVTFSAIGEGFHNYHHTFPFDYATSEFGCKLNLTTCCFIDLMCFLGLAREPKRVSREAVLARAQRTGDGSHWSG

SEQ ID NO: 145 - protein, 324 aa, Cyprinus carpio
MPDRDIKSPIWHPETVEDVFDHTYKEKEGPKPPTVIVWRNVLLMAFLHTGALYGLVLFPSASVLTWIWFLACFVFSALGVTAGAHRLWSRRSYKASLPLRIFLAFANSMGFQNDIYEWSRDHRVHHKYSETDADPHNAVRGFFFSHIGWLLVRKHPDVIEKGRKLELSDLKADKVVMFQRRFYKSSVLLMCFFVPTFVPWYVWGESLWVAYFVPAVLRYALVLNATWLVNSAAHMWGNRPYDSSINPRENRFVAFSAIGEGFHNYHHTFPFDYATSEFGCKLNLTTCFIDLMCFLGLAREPKRVSREAALARAQRTGDGSHRTG

SEQ ID NO: 146 - protein, 248 aa, Homo sapiens
ILLGALHLGALYLLALLPTELKWKTVIVALLLYVITGGLGITAGYHRLWSHRSYKAKLPLRIFLAIFGTLAVQGSIYEWARDHRAHHKYSDTDADPHDANRGFFFSHVGWLLVKKHPAVKEKGKKLDLSDLKADPVVRFQHRYYIPLMVLMGFILPTLVPGYLWGETFWGGFVWAGFLRLVFVLHATWCVNSAAHKFGYRPYDSRITPRNNWLVALVTFGEGWHNFHHTFPYDYRNAEKWKWEYDLTK

SEQ ID NO: 147 - protein, 389 aa, Homo sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKSFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 148 - protein, 389 aa, Homo sapiens [sequence omitted]

SEQ ID NO: 149 - protein, 389 aa, Mus musculus
MLEEPRSRPPPLGLAGLLFLALFSRALSNEILGLKLPGEPPLTANTVCLTLSGLSKRQLGLCLRSPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKTFPISQPSPVPGSVPSPGPQDTWEWGGCNHDMDFGEKFSRDFLDSREAPRDIQARMRIHNNRVGRQVVTENLKRKCKCHGTSGSCQFKTCWRAAPEFRAIGAALRERLSRAIFIDTHNRNSGAFQPRLRPRRLSGELVYFEKSPDFCERDPTLGSPGTRGRACNKTSRLLDGCGSLCCGRGHNVLRQTRVERCHCRFHWCCYVLCDECKVTEWVNVCK

SEQ ID NO: 150 - protein, 390 aa, Takifugu rubripes
MEPPHKFRWDKFLILATALMSPAFTVLCNDILSLKVAGEPVLTPNSVCLKLAGLSKRQMRMCVRSPDATASALQGIQVAIHECQYQLRDQRWNCSSLEGLGKLPHHNTILNRGFRESAFSLAMLAAGVAHSVASACSMGKLRGCGCEAKRRQDDDKIRLKLTQLQLQSLQKDDLSSMQETWEWGGCSHDVRYGDRFSRDWLDSRGSPRDIHARMKIHNNRVGRQIVTDNMKRKCKCHGTSGSCQFQTCWHVSPEFRLVGSLLKEKFLSAILVNSQNKNNGVFNPRIGSGVSGSTGGLNGGRRRSMSRELVYFEKSPDFCEPNLSVDSAGTQGRICNKTSQSTDSCGSLCCGRGHNILKKTHSERCNCRFHWCCYVLCEECRLTEWVNVCK

SEQ ID NO: 151 - protein, 417 aa, Mus musculus [sequence omitted]

SEQ ID NO: 152 - protein, 115 aa, Homo sapiens
LCRSLPGLSPRQRQLCRRNPDVMASVSEGAQLAIQECQHQFRGRRWNCSTLDSLNERSVFGKVLKKGTRETAFVYAISSAGVAHAVTRACSEGELESCGCDDKRKADEERLRIKL

SEQ ID NO: 153 - protein, 85 aa, Homo sapiens
MSCSCGGNCGCGSGCKCGSGCGGCKMYPDLSETTSSTTTEATTLVLGVAPEKKAQFEGSEMGVAVAAEENGCKCGSNCKCDPCNC

SEQ ID NO: 154 - protein, 193 aa, Homo sapiens
RDRDARSLMNLHNNEAGRKAVKSHMRRECKCHGVSGSCSLKTCWLSLPDFREVGDLLKEKYDGAIEVEVNKRGKGQRSLSSRKQASALEAANERFKKPTRNQYTDLVYLEKSPDYCERDRETGSLGTQGRVCNKTSKGLQWRDGCELLCCGRGYNTEQKVERTEKCNCKFHNGWCCYVKCEECTEVVEVHTCK

SEQ ID NO: 155 - protein, 348 aa, Rattus norvegicus
MVLLAQGACCSNQWLAAVLLSLCSCLPAGQSVDFPWAAVDNMLVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTINEGTNVTLTCLATGKPEPAISWRHISPSAKPFENGQYLDIYGITRDQAGEYECSAENDVSFPDVKKVRVVVNFAPTIQEIKSGTVTPGRSGLIRCEGAGVPPPAFEWYKGEKRLFNGQQGIIIQNFSTRSILTVTNVTQEHFGNYTCVAANKLGTTNASLPLNPPSTAQYGITGSACDLFSCWSLALTLSSVISIFYLKNAILQ

SEQ ID NO: 156 - protein, 352 aa, Gallus gallus
MVPLVRGAGGSHQWLAAVLLGLCCLLPAGRLAAPGGDFPGAAADSLVVRKGDTAVLRCYLEDGASKGAWLNRSSIIFAGSDKWSVDPRVSIATANRREYSLQIQDVDVTDDGPYTCSVQTQHTPRTMQVHLTVQVSPKIFRISSDIVVNEGSNVTLVCLATGKPEPSISWRHISPSAKPFESGQYLDIYGITRDQAGEYECSAENDVSVPDVKKVKVTVNFAPTIQELKSSGVMLGGNGLIRCEGAGVPAPVFEWYRGERKLISGQQGITIKNYSTRSLLTVTNVTEEHFGNYTCVAANKLGMTNASLPLNPPSTAQYGITGDAEVLFSCWYLVLTLSSLTSIFYLKNIILH

SEQ ID NO: 157 - protein, 261 aa, Gallus gallus
MVPLVRGAGGSHQWLAAVLLGLCCLLPAGRLAAPGGDFPGAAADSLVVRKGDTAVLRCYLEDGASKGAWLNRSSIIFAGSDKWSVDPRVSIATANRREYSLQIQDVDVTDDGPYTCSVQTQHTPRTMQVHLTVQVSPKIFRISSDIVVNEGSNVTLVCLATGKPEPSISWRHISPSAKPFESGQYLDIYVITRDQAGEYECSAENDVSVPDVKKVKVTVNSPSTAQYGITGDAEVLFSCWYLVLTLSSLTSIFYLKNIILH

SEQ ID NO: 158 - protein, 338 aa, Homo sapiens
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 159 - protein, 338 aa, Gallus gallus
MVARAQPDRKQLPLVLLRLLCLLPTGLPVRSVDFTRGTDNITVRQGDTAILRCFVEDRSSKVAWLNRSGIIFAGEDKWSLDPRVELEKRSPLEYSLRIQKVDVYDEGSYTCSVQTQHHPKTSQVYLIVQVPPKISNISSDITVNEGSNVTLVCMANGRPEPVITWRHLTPTGKEFEGEEEYLEILGITREQSGKYECKAANEVASADVKQVRVTVNYPPTITESKSNEAATGRQALLRCEASAVPTPDFEWYRDDTRINSANGLEIKSTGSQSLLMVANVTEEHYGNYTCVAANKLGVTNASLYLYRPGTGRVDNGSVSLAVPLWLLAASLLCLLSKC

SEQ ID NO: 160 - protein, 45 aa, Homo sapiens; identical to SEQ ID NO: 113

SEQ ID NO: 161 - protein, 45 aa, Homo sapiens; identical to SEQ ID NO: 113

SEQ ID NO: 162 - protein, 45 aa, Homo sapiens; identical to SEQ ID NO: 113

SEQ ID NO: 163 - protein, 577 aa, Homo sapiens
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIATDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 164 - protein, 456 aa, Homo sapiens
RFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIV

SEQ ID NO: 165 - protein, 361 aa, Homo sapiens [sequence omitted]

SEQ ID NO: 166 - protein, 305 aa, Homo sapiens
ILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 167 - protein, 419 aa, Mus musculus
MEMTGKKARTWASIHLNTFFAIGAMLVALASYLLKTWWLYQIILCIVTTPFILCCWMLPETPFWLLSEGRYKEAQGTVDTMAVWNKSSSCDLVELLSLDVTRSHNKSPHSIRKHRLADLFHNLDVAKMTLIVWLDWFTANLGYYMFGKEVIRRKENEPLYLLLVGAMEIPAYICLCIWLKRVGRRKTMLLFLLVSSLTCMLHVVMPSDYKTAKRMVALLVKSVISSVFAFIYLYTAELYPTTVRCLAVGSSNMVSHVSSIFIPFTSHFSKVWIFLPQILFGILAILSGLLSLKLPETQDTPMKSTWETTEQQVPENKDSLGEGPPDSFERWDSSRALSFAERWGLSRASPDAEKWGSGRVPPDAGKWGAGIAPPVTERGASGRASLEDESGGSGRAPPEKNTEMENEIENMKVSNLGGF

SEQ ID NO: 168 - protein, 267 aa, Homo sapiens
QYEFMQRALLASILVGLACGILGSFLVLRRQSLMGDAISHAVLPGVALAFFLGINKSLEIPLIGAFLFGLIAAVAIGYLKRNSRLKEDTAIGIVFSSFLALGLLLISLIKGSNAASKVDLDHYLFGNILGISQQDLIQIAIITAIILLLLLLFWKELLLITFDPDLAKVIGLPVNFLKLLLLILLALTIVVALQAVGVILVIALLITPAATARLLTKSLESMLLIASAIGVVSSVAGLLLSYYFDTATGPVIVLIATLLFLISFLFA

SEQ ID NO: 169 - protein, 119 aa, Homo sapiens
LLILLLVLLAPLAEELFFRGILLTALERRLKKRYTLFGPLLAIIISSLIFALLHLANALELLQLLGNVLIQPVLINWLQLLYTFLLGLVLGLLYLRRTGSLLAPILVHALNNLIGFILL

SEQ ID NO: 170 - protein, 488 aa, Homo sapiens
VALVAALGGGFLFGYDTGVIGGFLALIDFLFRFGLLTSSGALAELVGYSTVLTGLVVSIFFLGRLIGSLFAGKLGDRFGRKKSLLIALVLFVIGALLSGAAPGYTTIGLWAFYLLIVGRVLVGLGVGGASVLVPMYISEIAPKALRGALGSLYQLAITIGILVAAIIGLGLNKTNNDSALNSWGWRIPLGLQLVPALLLLIGLLFLPESPRWLVEKGKLEEAREVLAKLRGVEDVDQEIQEIKAELEATVSEEKAGKASWGELFRGRTRPKVRQRLLMGVMLQAFQQLTGINAIFYYSPTIFKSVGVSDSVASLLVTIIVGVVNFVFTFVALIFLVDRFGRRPLLLLGAAGMAICFLILGASIGVALLLLNKPKDPSSKAAGIVAIVFILLFIAFFALGWGPIPWVILSELFPTKVRSKALALATAANWLANFIIGFLFPYITGAIGLALGGYVFLVFAGLLVLFILFVFFFVPETKGRTLEEIEELF

SEQ ID NO: 171 - protein, 343 aa, Homo sapiens; identical to SEQ ID NO: 34

SEQ ID NO: 172 - protein, 343 aa, Homo sapiens [sequence omitted]

SEQ ID NO: 173 - protein, 344 aa, Homo sapiens
MLATRTLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVFRSEEVEKVVGDCPFEPEGPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYNPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 174 - protein, 343 aa, Homo sapiens
GLRPPPPGRFSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVFRSEEVEKVVGDCPFEPEGPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYNPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 175 - protein, 344 aa, Rattus norvegicus
MMLAARLSRPLSQLPGKALSVCDRENGTRHTLLFYPASFSPDTRRTYTSQADAASGKAVLVTGCDSGFGFSLAKHLHSKGFLVFAGCLLKEQGDAGVRELDSLKSDRLRTIQLNVCNSEEVEKAVETVRSGLKDPEKGMWGLVNNAGISTFGEVEFTSMETYKEVAEVNLWGTVRTTKSFLPLLRRAKGRVVNISSMLGRMANPARSPYCITKFGVEAFSDCLRYEMHPLGVKVSVVEPGNFIAATSLYSPERIQAIAKKMWDELPEVVRKDYGKKYFDEKIAKMETYCNSGSTDTSSVINAVTHALTAATPYTRYHPMDYYWWLRMQVMTHFPGAISDKIYIH

SEQ ID NO: 176 - protein, 271 aa, Homo sapiens
TGKVALVTGASSGIGLAIAKRLAKEGAKVVVVDRREEKAEQVAAELKAELGDRALFIQLDVTDEEQVKAAVAQAVERLGDRLDVLVNNAGILGPGPPFEELSEEDWERVIDVNLTGVFLLTQAVLPAMDHMLKRKGGRIVNISSVAGLNVGVPGLSAYSASKAAVIGLTRSLALELAPHGTGIRVNAVAPGGVDTDMTKALRSRLIEAKKKVREVADIADPELEERITSTITPLGRYGVTPEEIANAVLFLASDGASYSVTGQTLNVDGGL

SEQ ID NO: 177 - protein, 256 aa, Homo sapiens
YDVWMGNSRGNTWSRRHKTLSETDEKFWAFGFDEMAKYDLPGVIDFIVNKTGQEKLYFIGHSLGTTIGFVAFSTMPELAQRIKMNFALGPTISFKYPTGIFTRFFLLPNSIIKAVFGTKGFFLEDKKTKIASTKICNNKILWLICSEFMSLWAGSNKKNMNQLYHSDEFRAYDWGNDADNMKHYNQSHPPIYDLTAMKVPTAIWAGGHDVLVTPQDVARILPQIKSLHYFKLLPDWNHFDFVWGLDAPQRMYSEII

SEQ ID NO: 178 - protein, 95 aa, Homo sapiens
YQTLVPENEAAGTAVLRVVAQDPDAGEAGRLVYSLAALMNSRSLELFSIDPQSGLIRTAAALDRESMERHYLRVTAQDHGSPRLSATTMVAVTVA

SEQ ID NO: 179 - protein, 99 aa, Homo sapiens
YRETLRENVEEGYPILQLRATDGDAPPNANLRYRFVGPPAARAAAAAAFEIDPRSGLISTSGRVDREHMESYELVVEASDQGQEPGPRSATVRVHITVL

SEQ ID NO: 180 - protein, 93 aa, Homo sapiens
YVAQVREDVRPHTVVLRVTATDRDKDANGLVHYNIISGNSRGHFAIDSLTGEIQVVAPLDFEAEREYALRIRAQDAGRPPLSNNTGLASIQVV

SEQ ID NO: 181 - protein, 92 aa, Homo sapiens
FQVSVLENAPLGHSVIHIQAVDADHGENARLEYSLTGVAPDTPFVINSATGWVSVSGPLDRESVEHYFFGVEARDHGSPPLSASASVTVTVL

SEQ ID NO: 182 - protein, 45 aa, Homo sapiens; identical to SEQ ID NO: 80

SEQ ID NO: 183 - protein, 45 aa, Homo sapiens; identical to SEQ ID NO: 80

SEQ ID NO: 184 - protein, 45 aa, Homo sapiens; identical to SEQ ID NO: 80

SEQ ID NO: 185 - protein, 67 aa, Homo sapiens
CPANEQYTECGPSCEPSCSNPDGPLETTPPCEGTSPKVPSTCKEGCVCQPGYVRNNDGDKCVPRSEC

SEQ ID NO: 186 - protein, 45 aa, Homo sapiens; identical to SEQ ID NO: 80

SEQ ID NO: 187 - protein, 45 aa, Homo sapiens; identical to SEQ ID NO: 80

SEQ ID NO: 188 - protein, 45 aa, Homo sapiens; identical to SEQ ID NO: 80

SEQ ID NO: 189 - protein, 45 aa, Homo sapiens; identical to SEQ ID NO: 80

SEQ ID NO: 190 - protein, 18 aa, Homo sapiens
LPCEEVTSIIERDNIDFK

SEQ ID NO: 191 - protein, 30 aa, Homo sapiens
FDRPRGVAVDPSDGQIVVADQSENHRIQVF

SEQ ID NO: 192 - protein, 30 aa, Homo sapiens; identical to SEQ ID NO: 191

SEQ ID NO: 193 - protein, 28 aa, Homo sapiens
LKVEFDELETGLLKSITRKQDNKTVHVN

SEQ ID NO: 194 - protein, 89 aa, Homo sapiens
YHLRLNEDAAVGTSVVSVTAVDRDANSAISYQITGGNTRNRFAISTQGGVGLVTLALPLDYKQERYFKLVLTASDRALHDHCYVHINIT

SEQ ID NO: 195 - protein, 90 aa, Homo sapiens
YSVSVNEDRPMGSTIVVISASDDDVGENARITYLLEDNLPQFRIDADSGAITLQAPLDYEDQVTYTLAITARDNGIPQKADTTYVEVMVN

SEQ ID NO: 196 - protein, 45 aa, Homo sapiens; identical to SEQ ID NO: 80

SEQ ID NO: 197 - protein, 45 aa, Homo sapiens; identical to SEQ ID NO: 80

SEQ ID NO: 198 - protein, 45 aa, Homo sapiens; identical to SEQ ID NO: 80

SEQ ID NO: 199 - protein, 45 aa, Homo sapiens; identical to SEQ ID NO: 80

SEQ ID NO: 200 - protein, 45 aa, Homo sapiens; identical to SEQ ID NO: 80

SEQ ID NO: 201 - protein, 45 aa, Homo sapiens; identical to SEQ ID NO: 80

SEQ ID NO: 202 - protein, 45 aa, Homo sapiens; identical to SEQ ID NO: 80

SEQ ID NO: 203 - protein, 18 aa, Homo sapiens
LPCEEVTSIIERDNIDFK

SEQ ID NO: 204 - protein, 30 aa, Homo sapiens; identical to SEQ ID NO: 191

SEQ ID NO: 205 - protein, 30 aa, Homo sapiens; identical to SEQ ID NO: 191

SEQ ID NO: 206 - protein, 28 aa, Homo sapiens
LKVEFDELETGLLKSITRKQDNKTVHVN

SEQ ID NO: 207 - protein, 93 aa, Homo sapiens
YTGLVSEDAPPFTSVLQISATDRDAHANGRVQYTFQNGEDGDGDFTIEPTSGIVRTVRRLDREAVSVYELTAYAVDRGVPPLRTPVSIQVMVQ

SEQ ID NO: 208 - protein, 89 aa, Homo sapiens
FEVRVKENSIVGSVVAQITAVDPDEGPNAHIMYQIVEGNIPELFQMDIFSGELTALIDLDYEARQEYVIVVQATSAPLVSRATVHVRLV

SEQ ID NO: 209 - protein, 32 aa, Homo sapiens
CYSNPCRNGGACARREGGYTCVCRPRFTGEDC

SEQ ID NO: 210 - protein, 35 aa, Homo sapiens
CVPGVCRNGGTCTDAPNGGFRCQCPAGGAFEGPRC

SEQ ID NO: 211 - protein, 65 aa, Homo sapiens
FATVQQSGLLFYNGRLNEKHDFLALELVAGQVRLTYSTGESNTVVSPTVPGGLSDGQWHTVHLRY

SEQ ID NO: 212 - protein, 17 aa, Homo sapiens
GIDLGGTKIELALVDED

SEQ ID NO: 213 - protein, 12 aa, Homo sapiens
PVAEAIAKEIKK

SEQ ID NO: 214 - protein, 360 aa, Homo sapiens
MPLLGLGTWQTPGEEDYLWGRVDKEEAKEAVKAALDAGYRHIDTAAIYGNGQKPGQSEEEVGEAIKEALEEGSVVVITKYKREDIFITSDKLWNTFGPDLSEYGHSPKHVREALEKSLKRLGLDYVDLYLIHWPDPFKPGIEDKYPLGFPTDDDGKLIYEDVPIEETWKALEKLVDEGKVRSIGVSNFSAEQLEELLSYAGKLKLIPPVVNQVELHPYLRQDELRKVPLLPFCKSHGIAVTAYSPLGSGLLTGKYKTEEDIPGDRRSLLGADKGWSELGSPELLEDPVLKAIAEKYGYKDKTPAQVALRWALQRGGGAGVVVVIPKSSNPERIKENLKAFDDFELTEEDMKAIDELDRGK

SEQ ID NO: 215 - protein, 17 aa, Homo sapiens
GIDLGGTKIELALVDED

SEQ ID NO: 216 - protein, 139 aa, Homo sapiens
MPLLGLGTWQTPGEEDYLWGRVDKEEAKEAVKAALDAGYRHIDTAAIYGNGQKPGQSEEEVGEAIKEALEEGSVVVITKYKREDIFITSDKLWNTFGPDLSEYGHSPKHVREALEKSLKRLGLDYVDLYLIHWPDPFKP

SEQ ID NO: 217 - protein, 64 aa, Homo sapiens
PTDDDGKLIYEDVPIEETWKALEKLVDEGKVRSIGVSNFSAEQLEELLSYAGKLKLIPPVVNQV

SEQ ID NO: 218 - protein, 54 aa, Homo sapiens
ALRWALQRGGGAGVVVVIPKSSNPERIKENLKAFDDFELTEEDMKAIDELDRGK

SEQ ID NO: 219 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 220 - protein, 249 aa, Homo sapiens
RHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 221 - protein, 243 aa, Homo sapiens
DEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 222 - protein, 200 aa, Unknown Organism
  Description of Unknown Organism: unidentified
LKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDCARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 223 - protein, 267 aa, Cynomolgus monkey
MKATVLTLAVLFLTGSQARHFWQQDEPPQTPWDRVKDLVTVYVEALKDSGKDYVSQFEGSALGKQLNLKLLDNWDSVTSTVSKLREQLGPVTQEFWDNLEKETEGLRQEMSKDLEEVKAKVQPYLDDFQKKWQEEMELYRQKVEPLRAELHEGTRQKLHELHEKLSPLGEEVRDRARAHVDALRTHLAPYSDELRQRLAARLEALKENGGARLAEYHAKASEHLSTLSEKAKPALEDLRQGLLPVLESFKVSFLSALEEYTKKLSTQ

SEQ ID NO: 224 - protein, 90 aa, Homo sapiens
MATTYEEFAAKLDRLDEEFNKKMEEQNAKFFADKPDESTLSPEMKEHYEKFEKMIQEHTDKFNKKMREHSEHFKQKFAELLEQQKNAQYP

SEQ ID NO: 225 - protein, 277 aa, Homo sapiens
KALVLALALLLLTGCQARSFWQADEPEVTEQAWQQSQWDQVKDRFWVYLRQVKDSSDQAVEQLESSQVTQELNLLLEDNLDELKSYAEELQEQLGPVAQEFQARLSKETQALRAELGKDLEDVRNRLAPYRDEVQAMLGQNLEEYRQRLEPLARELRKRLRRDAEELQKRLAPYAEELRERAERNVDALRERLGPYVEQLRQKAATLLTQRLEELRERAQPYAEEYKEQLEEQLSELREKLAPVREDLQEVLTPVLEQAQLKLQAEAFQEELKKKLE

SEQ ID NO: 226 - protein, 267 aa, Homo sapiens; identical to SEQ ID NO: 219

SEQ ID NO: 227 - protein, 249 aa, Homo sapiens; identical to SEQ ID NO: 220

SEQ ID NO: 228 - protein, 243 aa, Homo sapiens; identical to SEQ ID NO: 221

SEQ ID NO: 229 - protein, 200 aa, Unknown Organism; identical to SEQ ID NO: 222
  Description of Unknown Organism: unidentified

SEQ ID NO: 230 - protein, 267 aa, Cynomolgus monkey; identical to SEQ ID NO: 223

SEQ ID NO: 231 - protein, 90 aa, Homo sapiens; identical to SEQ ID NO: 224

SEQ ID NO: 232 - protein, 277 aa, Homo sapiens; identical to SEQ ID NO: 225

SEQ ID NO: 233 - protein, 1348 aa, Homo sapiens
GAKDLVCSKMSRAKDAVSSGVASVVDVAKGVVQGGLDTTRSALTGTKEAVSSGVTGAMDMAKGAVQGGLDTSKAVLTGTKDTVSTGLTGAVNVAKGTVQAGVDTTKTVLTGTKDTVTTGVMGAVNLAKGTVQTGVETSKAVLTGTKDAVSTGLTGAVNVARGSIQTGVDTSKTVLTGTKDTVCSGVTSAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTGAVNVAKGAVQTGVDTAKTVLTGTKDTVTTGLMGAVNVAKGTVQTSVDTTKTVLTGTKDTVCSGVTGAANVAKGAVQTGVDTAKTVLTGTKDTVCSGVTGAVNVAKGAVQTGLKTTQNIATGTKNTLGSGVTGAANVAKGAVQGGLDTTKSVLTGTKDAVSTGLTGAVNLAKGTVQTGMDTTKTVLTGTKDAVCSGVTGAANVAKGAVQTGVDTAKTVLTGTKDTVTTGLMGAVNVAKGTVQTSVDTTKTVLTGTKDTVCSGVTGAANVAKGAVQGGLDTTKSVLTGTKDTVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTDNGGEQTALSPQEAPFSGISTPPDVLSVGPEPAWEAAATTKGLATDVATFTQGAAPGREDTGLLTTTHGPEEAPRLAMLQNELEGLGDIFHPMNAEEQAQLAASQPGPKVLSAEQGSYFVRLGDLGPSFRQRAFEHAVSHLQHGQFQARDTLAQLQDCFRLIEKAQQAPEGQPRLDQGSGASAEDAAVQEERDAGVLSRVCGLLRQLHTAYSGLVSSLQGLPAELQQPVGRARHSLCELYGIVASAGSVEELPAERLVQSREGVHQAWQGLEQLLEGLQHNPPLSWLVGPFALPAGGQ

SEQ ID NO: 234 - protein, 1403 aa, Mus musculus
MSASGDGTRVPPKSKGKTLSSFFGSLPGFSSARNLVSHTHSSTSTKDLQTATDPSGTPAPSSKVSTNSQMAGDAAGLLQPSEQTAGDKDMGSFSVTSSEDAFSGVFGIMDAAKGMVQGGLGATQSALVGTKEAVSGGVMGAVGVAKGLVKGGLDTSKNVLTNTKDTVTTGVMGAANMAKGTVQTGLDTTKSVVMGTKDTVATGLAGAVNVAKGTIQGGLDTTKSVVMGTKDTVTTGLTGAANVAKGVVQGGLDTTKSVVMGTKDTVTTGLTGAMNVAKGTAQMGIDTSKTVLTGTKDTVCAGATGAINVAKGAAQGGLDTTKSVLIGTKDTVTTGLTGAVNVAKGAVQGGLDTTKSVVMGTKDTVTTGLTGAMNVAKGTAQMGLGTSKTVLTGTKDTVCAGLTGAINVAKGAAQGGLDTTKSVLMGTKDTVTTGLTGAVNVAKGTIQGGLDTTKSVVMGTKDTVTTGLTGAVNVAKGTIQGGLDTTKSVVMGTKDTVTTGLTGAVNVAKGAAQGGLDTTKSVVMGTKDTVTTGLTGAMNVAKGTAQMGLGTSKTVLTGTKDTVCAGLTGAINVAKGAAQGGLDTTKSVLMGTKDTVTTGLTGAVNVAKGTIQGGLDTTKSVVMGTKDTVTTGLTGAVNVAKGAVQGGLDTTKSVVMGTKDTVTTGLTGALNVAKGTAQMGIDTSKTVLIGTKDTVCAGATGAINMAKGAAQGGLDTTKSVLMGTKDTVTTGLTGAINVAKGSAQGGLDTTKSVLIGTKDTVTTGLTGALNVAKGTVQTGLDTSQRVLTGTKDNVYAGVTGAVNVAKGTIQGGLDTTKSVVMGTKDTVTTGLTGAVNVAKGAVQGGLDTTKSVVMGTKDTVTTGLTGAMNVAKGTAQMGIDTSKTVLTGTKDTVCAGLTGAINVAKGATQGGLDTTKSVLMGTKDTVTTGLTGAINVAKGAAQGGLDTTKSVLLGTKDTVTTGLTGAANVAKETVQMGLDTSKNILMDTKDSICAGATGAITVVKGAAQGGLDTSNAALTGTMDTAKGTVQTSLDTSKHMLIGMKDTVCAGVTSAMNMAKGIHKNTDTTRDTQSSVLAHSGNVATNAIHTGVHTVPSSLSGSHSIICHEPSIYRATNHGVGHAILTSTESLCCETSSFSDKYGLGHVTEPRADTKTLVSGMASSACAATRSVEECGQLAATGFAALPDELKGLGDIFQPMTTEEQAQLAVSESGPRVLSADRGSYYIRLGDLAPSFRQRAFEHALSHIQHNQFQARAAVAQLQEAFQMTDMTMEAACGKLCSDQSLNTMVEAVGSHEMRASVAQDRLCTLAHQLHAAYSSLVTSLQGLPEVQQQAGQARHSLCKLYGLVSSEAGSELQTEQLAQSSAGVVEAWQGLEVLLEKLQQNPPLSWLVGPFTSMPCGQL

SEQ ID NO: 235 - protein, 75 aa, Homo sapiens
EKAKETADSAKEKASEAKDAAKDKAEEAKDAAKEKAEEAKDKAKEKKAGEAKDKTGNKAKEKAEEAKDKASDAKD

SEQ ID NO: 236 - protein, 75 aa, Homo sapiens; identical to SEQ ID NO: 235

SEQ ID NO: 237 - protein, 75 aa, Homo sapiens; identical to SEQ ID NO: 235

SEQ ID NO: 238 - protein, 75 aa, Homo sapiens; identical to SEQ ID NO: 235

SEQ ID NO: 239 - protein, 411 aa, Homo sapiens
MATAVEDLPQQESVVDRVASLPLVSSTIKCDLVSAAYDSTKENYPLVKGVKSVCEAAEKGVETITSAAVTSAQPIVKKLEPQIAVANEYACKGLDKLEEKLPILQQPPEKIVANAKGAVTGAKDAVSTRVESAKDSVVQPILERVDKVKGAVQAGVESTKSVVTGSANTVLGSRVGQLASSGVDTALGKSEKLVEQYLPPTEEELEKEAKKVEGFDSKKVQQQRQKPSALVRLGSLSEKLRRRAYQQALGRVRAAKQRSQEAIHQLQSVAELIETAKKGVSQANQKVSRAQDKLYVLWLEWKASSGEDPEDESDTEPEQIESRILLLTRELAQQLVAALKTLLSSIQGIPQNLQDTVQQVGSMSGDAYSAFRSRAASFKETSDGLLTSSKGRVASLKEALDEVMDYVVSNT

SEQ ID NO: 240 - protein, 1348 aa, Homo sapiens; identical to SEQ ID NO: 233

SEQ ID NO: 241 - protein, 1403 aa, Mus musculus; identical to SEQ ID NO: 234

SEQ ID NO: 242 - DNA, 28 bp, Artificial Sequence
  Description of Artificial Sequence: chemically synthesized
gtaaattggaagagtttgttcaagggaa

SEQ ID NO: 243 - DNA, 29 bp, Artificial Sequence
  Description of Artificial Sequence: chemically synthesized
cttggaaatccatctttcattaagtgagc

SEQ ID NO: 244 - DNA, 27 bp, Artificial Sequence
  Description of Artificial Sequence: chemically synthesized
ctatctgccaattttcattgtggacag

SEQ ID NO: 245 - DNA, 27 bp, Artificial Sequence
  Description of Artificial Sequence: chemically synthesized
ttcgaattaaggttccaaggctatgag

SEQ ID NO: 246 - DNA, 19 bp, Artificial Sequence
  Description of Artificial Sequence: chemically synthesized
cgggaagactcgccagcac

SEQ ID NO: 247 - DNA, 30 bp, Artificial Sequence
  Description of Artificial Sequence: chemically synthesized
aaagccttttatgggtctttgaatttattg

SEQ ID NO: 248 - DNA, 25 bp, Artificial Sequence
  Description of Artificial Sequence: chemically synthesized
tgctgagggtgcatttatgtttcag

SEQ ID NO: 249 - DNA, 26 bp, Artificial Sequence
  Description of Artificial Sequence: chemically synthesized
ccacacgtggataatcaagagttgac

SEQ ID NO: 250 - DNA, 19 bp, Artificial Sequence
  Description of Artificial Sequence: chemically synthesized
gcggcggccatgggagata

SEQ ID NO: 251 - DNA, 26 bp, Artificial Sequence
  Description of Artificial Sequence: chemically synthesized
aggaaggggaagcgtcctcagtattc

SEQ ID NO: 252 - DNA, 19 bp, Artificial Sequence
  Description of Artificial Sequence: chemically synthesized
gcggcggccatgggagata

SEQ ID NO: 253 - DNA, 26 bp, Artificial Sequence
  Description of Artificial Sequence: chemically synthesized
aggaaggggaagcgtcctcagtattc

SEQ ID NO: 254 - DNA, 24 bp, Artificial Sequence
  Description of Artificial Sequence: chemically synthesized
agcacgcacttgcccagagctatc

SEQ ID NO: 255 - DNA, 21 bp, Artificial Sequence
  Description of Artificial Sequence: chemically synthesized
cctatggctgaaggcggaggt

SEQ ID NO: 256 - DNA, 18 bp, Artificial Sequence
  Description of Artificial Sequence: chemically synthesized
ctgggtctcccctcccac

SEQ ID NO: 257 - DNA, 21 bp, Artificial Sequence
  Description of Artificial Sequence: chemically synthesized
gtttattctgagcaccgggaa

SEQ ID NO: 258 - DNA, 19 bp, Artificial Sequence
  Description of Artificial Sequence: chemically synthesized
aggcctgcaggtgggtgtc

SEQ ID NO: 259 - DNA, 24 bp, Artificial Sequence
  Description of Artificial Sequence: chemically synthesized
ctgcaggctcctacagctactgcc

SEQ ID NO: 260 - DNA, 22 bp, Artificial Sequence
  Description of Artificial Sequence: chemically synthesized
tcctgaggtgtggatgaatact

SEQ ID NO: 261 - DNA, 27 bp, Artificial Sequence
  Description of Artificial Sequence: chemically synthesized
catcatctacaatggctaccccagtga

SEQ ID NO: 262 - DNA, 22 bp, Artificial Sequence
  Description of Artificial Sequence: chemically synthesized
ccatcttcagtggtgacttcat

SEQ ID NO: 263 - DNA, 20 bp, Artificial Sequence
  Description of Artificial Sequence: chemically synthesized
gaaacagtcggggaaacact

SEQ ID NO: 264 - DNA, 27 bp, Artificial Sequence
  Description of Artificial Sequence: chemically synthesized
tggtcaagaagacacaaaacactctca

SEQ ID NO: 265 - DNA, 20 bp, Artificial Sequence
  Description of Artificial Sequence: chemically synthesized
aaaccaaaggcccagaattt

SEQ ID NO: 266 - DNA, 22 bp, Artificial Sequence
  Description of Artificial Sequence: chemically synthesized
ggggaaatgacgctgataatat

SEQ ID NO: 267 - DNA, 26 bp, Artificial Sequence
  Description of Artificial Sequence: chemically synthesized
cccctatatatgacctgactgccatg

SEQ ID NO: 268 - DNA, 22 bp, Artificial Sequence
  Description of Artificial Sequence: chemically synthesized
cccaaatagcagtaggcacttt

SEQ ID NO: 269 - DNA, 20 bp, Artificial Sequence
  Description of Artificial Sequence: chemically synthesized
gaaacagtcggggaaacact

SEQ ID NO: 270 - DNA, 27 bp, Artificial Sequence
  Description of Artificial Sequence: chemically synthesized
tggtcaagaagacacaaaacactctca

SEQ ID NO: 271 - DNA, 20 bp, Artificial Sequence
  Description of Artificial Sequence: chemically synthesized
aaaccaaaggcccagaattt

SEQ ID NO: 272 - DNA, 22 bp, Artificial Sequence
  Description of Artificial Sequence: chemically synthesized
tcctgaggtgtggatgaatact

SEQ ID NO: 273 - DNA, 27 bp, Artificial Sequence
  Description of Artificial Sequence: chemically synthesized
catcatctacaatggctaccccagtga

SEQ ID NO: 274 - DNA, 22 bp, Artificial Sequence
  Description of Artificial Sequence: chemically synthesized
ccatcttcagtggtgacttcat

SEQ ID NO: 275 - DNA, 22 bp, Artificial Sequence
  Description of Artificial Sequence: chemically synthesized
ggggaaatgacgctgataatat

SEQ ID NO: 276 - DNA, 26 bp, Artificial Sequence
  Description of Artificial Sequence: chemically synthesized
cccctatatatgacctgactgccatg

SEQ ID NO: 277 - DNA, 22 bp, Artificial Sequence
  Description of Artificial Sequence: chemically synthesized
cccaaatagcagtaggcacttt

SEQ ID NO: 278 - DNA, 21 bp, Artificial Sequence
  Description of Artificial Sequence: chemically synthesized
tcactgctatgtgcacatcaa

SEQ ID NO: 279 - DNA, 25 bp, Artificial Sequence
  Description of Artificial Sequence: chemically synthesized
catcacagatgccaacactcatcgg

SEQ ID NO: 280 - DNA, 22 bp, Artificial Sequence
  Description of Artificial Sequence: chemically synthesized
actgagtagtgggcactttgaa

SEQ ID NO: 281 - DNA, 22 bp, Artificial Sequence
  Description of Artificial Sequence: chemically synthesized
agccacatgtcttcgatctaca

SEQ ID NO: 282 - DNA, 26 bp, Artificial Sequence
  Description of Artificial Sequence: chemically synthesized
acaacatgttctgtgctggcttccat

SEQ ID NO: 283 - DNA, 22 bp, Artificial Sequence
  Description of Artificial Sequence: chemically synthesized
cccactatctccttgacatgaa

SEQ ID NO: 284 - DNA, 20 bp, Artificial Sequence
  Description of Artificial Sequence: chemically synthesized
cccattcagcttcacagaga

SEQ ID NO: 285 - DNA, 27 bp, Artificial Sequence
  Description of Artificial Sequence: chemically synthesized
cagatcctggcattctctcagaagctg

SEQ ID NO: 286 - DNA, 22 bp, Artificial Sequence
  Description of Artificial Sequence: chemically synthesized
atgctcactgtctgttccttgt

SEQ ID NO: 287 - DNA, 20 bp, Artificial Sequence
  Description of Artificial Sequence: chemically synthesized
ctttccactgctctgcaaag

SEQ ID NO: 288 - DNA, 26 bp, Artificial Sequence
  Description of Artificial Sequence: chemically synthesized
aacccagctgtcacccagtacaggtg

SEQ ID NO: 289 - DNA, 22 bp, Artificial Sequence
  Description of Artificial Sequence: chemically synthesized
gtcctgtacacctctccagatg

SEQ ID NO: 290 - DNA, 22 bp, Artificial Sequence
  Description of Artificial Sequence: chemically synthesized
accaatggatccactcctatct

SEQ ID NO: 291 - DNA, 26 bp, Artificial Sequence
  Description of Artificial Sequence: chemically synthesized
ctgactccaaccaggacagcaagatg

SEQ ID NO: 292 - DNA, 22 bp, Artificial Sequence
  Description of Artificial Sequence: chemically synthesized
attctcagcaggctcttgatct

SEQ ID NO: 293 - DNA, 22 bp, Artificial Sequence
  Description of Artificial Sequence: chemically synthesized
ttgagttgactccagaggacat

SEQ ID NO: 294 - DNA, 26 bp, Artificial Sequence
  Description of Artificial Sequence: chemically synthesized
attgatggcctcaacagaaatctccg

SEQ ID NO: 295 - DNA, 22 bp, Artificial Sequence
  Description of Artificial Sequence: chemically synthesized
ccagcaagactgaagaaagaaa

SEQ ID NO: 296 - DNA, 22 bp, Artificial Sequence
  Description of Artificial Sequence: chemically synthesized
tctatggtcatgggtacgaaag

SEQ ID NO: 297 - DNA, 24 bp, Artificial Sequence
  Description of Artificial Sequence: chemically synthesized
acacgatgtccactgggctcacag

SEQ ID NO: 298 - DNA, 20 bp, Artificial Sequence
  Description of Artificial Sequence: chemically synthesized
gttgtgttcagcccagtttg

SEQ ID NO: 299 - DNA, 22 bp, Artificial Sequence
  Description of Artificial Sequence: chemically synthesized
gacctgatagacaaccctgtga

SEQ ID NO: 300 - DNA, 26 bp, Artificial Sequence
  Description of Artificial Sequence: chemically synthesized
acggcaagtctcctgctcagattttg

SEQ ID NO: 301 - DNA, 22 bp, Artificial Sequence
  Description of Artificial Sequence: chemically synthesized
atcacattcctctggatttgaa

SEQ ID NO: 302 - DNA, 22 bp, Artificial Sequence
  Description of Artificial Sequence: chemically synthesized
ggtaggtactgtcggtgaattg

SEQ ID NO: 303 - DNA, 30 bp, Artificial Sequence
  Description of Artificial Sequence: chemically synthesized
cttcatcaaatgaaaataatttcgagcaag

SEQ ID NO: 304 - DNA, 19 bp, Artificial Sequence
  Description of Artificial Sequence: chemically synthesized
gcaatcgcagcttcttcag

SEQ ID NO: 305 - DNA, 22 bp, Artificial Sequence
  Description of Artificial Sequence: chemically synthesized
agggactacagcctccagatac

SEQ ID NO: 306 - DNA, 26 bp, Artificial Sequence
  Description of Artificial Sequence: chemically synthesized
atggcccatacacgtgttctgttcag

SEQ ID NO: 307 - DNA, 22 bp, Artificial Sequence
  Description of Artificial Sequence: chemically synthesized
cattgttctgggtgtatgttga

SEQ ID NO: 308 - DNA, 22 bp, Artificial Sequence
  Description of Artificial Sequence: chemically synthesized
gctggtaccttgtgttgacact

SEQ ID NO: 309 - DNA, 27 bp, Artificial Sequence
  Description of Artificial Sequence: chemically synthesized
ccagcatattctacctgaagaatgcca

SEQ ID NO: 310 - DNA, 22 bp, Artificial Sequence
  Description of Artificial Sequence: chemically synthesized
aaagccttttatgggtctttga

SEQ ID NO: 311 - DNA, 22 bp, Artificial Sequence
  Description of Artificial Sequence: chemically synthesized
tctcttgcagattccagagagt

SEQ ID NO: 312 - DNA, 26 bp, Artificial Sequence
  Description of Artificial Sequence: chemically synthesized
tgtgccttccagaacatctcttgtgg

SEQ ID NO: 313 - DNA, 22 bp, Artificial Sequence
  Description of Artificial Sequence: chemically synthesized
tgaacacagaagccaagtagtg

SEQ ID NO: 314 - DNA, 21 bp, Artificial Sequence
  Description of Artificial Sequence: chemically synthesized
ctactactggtggctgcgaat

SEQ ID NO: 315 - DNA, 25 bp, Artificial Sequence
  Description of Artificial Sequence: chemically synthesized
cagatcatgacccacttgcctggag

SEQ ID NO: 316 - DNA, 22 bp, Artificial Sequence
  Description of Artificial Sequence: chemically synthesized
actcttcagcggatgtagatca

SEQ ID NO: 317 - DNA, 22 bp, Artificial Sequence
  Description of Artificial Sequence: chemically synthesized
acctactcggccactacctaga

SEQ ID NO: 318 - DNA, 29 bp, Artificial Sequence
  Description of Artificial Sequence: chemically synthesized
caccctatcaagaagtgcttttaaattca

SEQ ID NO: 319 - DNA, 22 bp, Artificial Sequence
  Description of Artificial Sequence: chemically synthesized
cagtgcatttccagctacagta

SEQ ID NO: 320 - DNA, 22 bp, Artificial Sequence
  Description of Artificial Sequence: chemically synthesized
cacggaacgtatcttcaagaaa

SEQ ID NO: 321 - DNA, 26 bp, Artificial Sequence
  Description of Artificial Sequence: chemically synthesized
ctgcacgtgtgaccctaactggactg

SEQ ID NO: 322 - DNA, 22 bp, Artificial Sequence
  Description of Artificial Sequence: chemically synthesized
gccacagtccacagaacatatt

SEQ ID NO: 323 - DNA, 22 bp, Artificial Sequence
  Description of Artificial Sequence: chemically synthesized
cagagaagcagacgagttcact

SEQ ID NO: 324 - DNA, 26 bp, Artificial Sequence
  Description of Artificial Sequence: chemically synthesized
caaggacagaattttaccctaaggca

SEQ ID NO: 325 - DNA, 22 bp, Artificial Sequence
  Description of Artificial Sequence: chemically synthesized
gttgctggttcacaaactccta

SEQ ID NO: 326 - DNA, 22 bp, Artificial Sequence
  Description of Artificial Sequence: chemically synthesized
ggcttccataattaccatcaca

SEQ ID NO: 327 - DNA, 27 bp, Artificial Sequence
  Description of Artificial Sequence: chemically synthesized
cctttccctttgactactctgcgagtg

SEQ ID NO: 328 - DNA, 21 bp, Artificial Sequence
  Description of Artificial Sequence: chemically synthesized
gcacatgaaatcaatgaacca

SEQ ID NO: 329 - DNA, 22 bp, Artificial Sequence
  Description of Artificial Sequence: chemically synthesized
ggcttccataattaccatcaca

SEQ ID NO: 330 - DNA, 27 bp, Artificial Sequence
  Description of Artificial Sequence: chemically synthesized
cctttccctttgactactctgcgagtg

SEQ ID NO: 331 - DNA, 21 bp, Artificial Sequence
  Description of Artificial Sequence: chemically synthesized
gcacatgaaatcaatgaacca

SEQ ID NO: 332 - DNA, 22 bp, Artificial Sequence
  Description of Artificial Sequence: chemically synthesized
acaacgccttgactcttcttct

SEQ ID NO: 333 - DNA, 26 bp, Artificial Sequence
  Description of Artificial Sequence: chemically synthesized
aagacctccaagcctcagggactctg

SEQ ID NO: 334 - DNA, 22 bp, Artificial Sequence
  Description of Artificial Sequence: chemically synthesized
acaagaagaaacaccccttgat

SEQ ID NO: 335 - protein, 32 aa, Homo sapiens
CDSGPCKNSGFCSERWGSFSCDCPVGFGGKDC

SEQ ID NO: 336 - protein, 135 aa, Homo sapiens
FRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSG

SEQ ID NO: 337 - protein, 32 aa, Homo sapiens
CASGPCPPHADCRDLWQTFSCTCQPGYYGPGC

SEQ ID NO: 338 - protein, 35 aa, Homo sapiens
CLLNPCQNQGSCRHLPGAPHGYTCDCVGGYFGHHC

SEQ ID NO: 339 - protein, 58 aa, Homo sapiens
YDACPKSLRSGVWWPQTKFGVLATVPCPRGALGAAVRLCDEAQGWLEPDLFNCTSPAF

SEQ ID NO: 340 - protein, 54 aa, Homo sapiens
SKAICVQWDPPGLAEQHGVWTARDCELVHRNGSHARCRCSRTGTFGVLMDASPR

SEQ ID NO: 341 - protein, 271 aa, Homo sapiens
LELLAVFTHVVVAVSVAALVLTAAILLSLRSLKSNVRGIHANVAAALGVAELLFLLGIHRTHNQVQDQGQGTCVLMTLLAQEAWGQNSGSELVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALRTLRSSFLLLLLVSASWLFGLLAVNHSILAFHYLHAGLCGLQGLAVLLLFCVLNADA

SEQ ID NO: 342 - protein, 311 aa, Homo sapiens
LGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRT

SEQ ID NO: 343 - protein, 189 aa, Homo sapiens
YSEAKEVRGVKVFRSSATVYFANAEFYSDALKQRCGVDVDFLISQKKKLLKKQEQLKLKQLQKEEKLRKQAGPLLSACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDA

SEQ ID NO: 344 - protein, 42 aa, Homo sapiens
LEEFVQGNLERECLEEKCSFEEAREVFENTERTTEFWKQYVD

SEQ ID NO: 345 - protein, 32 aa, Homo sapiens
CESNPCLNGGSCKDDINSYECWCPFGFEGKNC

SEQ ID NO: 346 - protein, 50 aa, Homo sapiens
ENTERTTEFWKQYVDGDQCESNPCLNGGSCKDDINSYECWCPFGFEGKNC

SEQ ID NO: 347 - protein, 228 aa, Homo sapiens
VVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWI

SEQ ID NO: 348 - protein, 154 aa, Homo sapiens
WCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEIGRMN

SEQ ID NO: 349 - protein, 115 aa, Homo sapiens
QAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSG

SEQ ID NO: 350 - protein, 52 aa, Homo sapiens
GSDAILSCAWTGNPSLTIVWMKRGSGVVLSNEKTLTLKSVRQEDAGKYVCRA

SEQ ID NO: 351 - protein, 146 aa, Homo sapiens
DMNQPLAHYFISSSHNTYLTDSQIGGPSSTEAYVRAFAQGCRCVELDCWEGPGGEPVIYHGHTLTSKILFRDVVQAVRDHAFTVSPYPVILSLENHCGLEQQAAMARHLCTILGDMLVTQALDSPNPEELPSPEQLKGRVLVKGKK

SEQ ID NO: 352 - protein, 80 aa, Homo sapiens
RLLKAWGNSFVRHNARQLTRVYPLGLRMNSANYSPQEMWNSGCQLVALNFQTPGYEMDLNAGRFLVNGQCGYVLKPACLR

SEQ ID NO: 353 - protein, 91 aa, Homo sapiens
LSIQVLTAQQLPKLNAEKPHSIVDPLVRIEIHGVPADCARQETDYVLNNGFNPRWGQTLQFQLRAPELALVRFVVEDYDATSPNDFVGQFT

SEQ ID NO: 354 - protein, 294 aa, Homo sapiens
LNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWKALEKCRDAGLTRSIRVSSFNHKLLELILNKPGLRYKPTCNQVECHPYLNQSKLLEFCKSKDIVLVAYSALGSQRDPQWVDPDCPHLLEEPILKSIAKKHSRSPGQVALRYQLQRGVVVLAKSFSQERIKENFQVFDFELTPEDMKAIDGLNRNL

SEQ ID NO: 355 - protein, 38 aa, Homo sapiens
MKEHSKTFSYAFDFLDLKRKKAIWAIYAVCRIIDDSID

SEQ ID NO: 356 - protein, 194 aa, Homo sapiens
DAAIMNALSNTLNTYSIPKKPFESLIQYVKEDLVLKEMKTDSDLYEYCYGVVGTVGELLTPILTSSNENNFEQAEEAAIALGKAMQITNILRDVGEDFQNGRIYLSVEKLAQYRVNLHSIYYEGVSPNYIELWESYATETVRLYDIALNGINYFDEEVRYIIELAAIAYHEILVEVRKANYTLHKKVYVSKLKK

SEQ ID NO: 357 - protein, 24 aa, Homo sapiens
TTEFLEFSFNFLPTIHNRTFSNQH

SEQ ID NO: 358 - protein, 24 aa, Homo sapiens
VLRHLNLKGNHFQDGTITKTNLLQ

SEQ ID NO: 359 - protein, 24 aa, Homo sapiens
SLEVLILSSCGLLSIDQQAFHSLG

SEQ ID NO: 360 - protein, 24 aa, Homo sapiens
KMSHVDLSHNSLTCDSIDSLSHLK

SEQ ID NO: 361 - protein, 64 aa, Homo sapiens
NPLDCTCSNIHFLTWYKENLHKLEGSEETTCANPPSLRGVKLSTSIWLPTALTSSHPVSSLSCP

SEQ ID NO: 362 - protein, 245 aa, Homo sapiens
VLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTT

SEQ ID NO: 363 - protein, 115 aa, Homo sapiens
VCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKL

SEQ ID NO: 364 - protein, 73 aa, Homo sapiens
VSCGCGWKGSGEQDRLRAKLLQLQALSRGKAPRDIQARMRIHNNRVGRQVVTENLKRKCKCHGTSGSCQFKTC

SEQ ID NO: 365 - protein, 169 aa, Homo sapiens
RDIQARMRIHNNRVGRQVVTENLKRKCKCHGTSGSCQFKTCWRAAPEFRAVGAALRERVGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 366 - protein, 68 aa, Homo sapiens
GDTAVLRCYLEDGASKGAWLNRSSIIFAGGDKWSVDPRVSISTLNKRDYSLQIQNVDVTDDGPYTCSV

SEQ ID NO: 367 - protein, 53 aa, Homo sapiens
GTNVTLTCLATGKPEPSISWRHISPSAKPFENGQYLDIYGITRDQAGEYECSA

SEQ ID NO: 368 - protein, 62 aa, Homo sapiens
GRSGLIRCEGAGVPPPAFEWYKGEKKLFNGQQGIIIQNFSTRSILTVTNVTQEHFGNYTCVA

SEQ ID NO: 369 - protein, 198 aa, Homo sapiens
QPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSI

SEQ ID NO: 370 - protein, 95 aa, Homo sapiens
LFLLGVVEIPAYTFVCIAMDKVGRRTVLAYSLFCSALACGVVMVIPQKHYILGVVTAMVGKFAIGAAFGLIYLYTAELYPTIVRSLAVGSGSMVC

SEQ ID NO: 371 - protein, 419 aa, Homo sapiens
KKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEE

SEQ ID NO: 372 - protein, 283 aa, Homo sapiens
SGKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAI

SEQ ID NO: 373 - protein, 27 aa, Homo sapiens
CPRNCHGNGECVSGTCHCFPGFLGPDC

SEQ ID NO: 374 - protein, 28 aa, Homo sapiens
CIDPQCGGRGICIMGSCACSSGYKGESC

SEQ ID NO: 375 - protein, 28 aa, Homo sapiens
CIDPGCSNHGVCIHGECHCSPGWGGSNC

SEQ ID NO: 376 - protein, 49 aa, Homo sapiens
CSSGYKGESCEEADCIDPGCSNHGVCIHGECHCSPGWGGSNCEILKTMC

SEQ ID NO: 377 - protein, 29 aa, Homo sapiens
CPDQCSGHGTYLQESGSCTCDPNWTGPDC

SEQ ID NO: 378 - protein, 27 aa, Homo sapiens
CSVDCGSHGVCMGGTCRCEEGWTGPAC

SEQ ID NO: 379 - protein, 27 aa, Homo sapiens
CHPRCAEHGTCKDGKCECSQGWNGEHC

SEQ ID NO: 380 - protein, 31 aa, Homo sapiens
CPGLCNSNGRCTLDQNGGHCVCQPGWRGAGC

SEQ ID NO: 381 - protein, 18 aa, Homo sapiens
FPSGNVTSVLELRNKDFR

SEQ ID NO: 382 - protein, 28 aa, Homo sapiens
LEWPTDLAINPMDNSIYVLDNNVVLQIT

SEQ ID NO: 383 - protein, 28 aa, Homo sapiens
LSAPSSLAASPDGTLYIADLGNIRIRAV

SEQ ID NO: 384 - protein, 26 aa, Homo sapiens
VNVTYSSTGQIASIQRGTTSEKVDYD

SEQ ID NO: 385 - protein, 27 aa, Homo sapiens
CPRNCHGNGECVSGTCHCFPGFLGPDC

SEQ ID NO: 386 - protein, 28 aa, Homo sapiens
CIDPQCGGRGICIMGSCACNSGYKGESC

SEQ ID NO: 387 - protein, 28 aa, Homo sapiens
CIDPGCSNHGVCIHGECHCSPGWGGSNC

SEQ ID NO: 388 - protein, 29 aa, Homo sapiens
CPDQCSGHGTYLQESGSCTCDPNWTGPDC

SEQ ID NO: 389 - protein, 27 aa, Homo sapiens
CSVDCGSHGVCMGGTCRCEEGWTGPTC

SEQ ID NO: 390 - protein, 27 aa, Homo sapiens
CHPRCAEHGTCKDGKCECSHGWNGEHC

SEQ ID NO: 391 - protein, 31 aa, Homo sapiens
CPGLCNSNGRCTLDQNGWHCVCQPGWRGAGC

SEQ ID NO: 392 - protein, 18 aa, Homo sapiens
FPSGNVTSVLELRNKDFR

SEQ ID NO: 393 - protein, 28 aa, Homo sapiens
LEWPTDLAINPMDNSIYVLDNNVVLQIT

SEQ ID NO: 394 - protein, 28 aa, Homo sapiens
LSAPSSLAASPDGTLYIADLGNIRIRAV

SEQ ID NO: 395 - protein, 26 aa, Homo sapiens
VNVTYSSTGQIASIQRGTTSEKVDYD

SEQ ID NO: 396 - protein, 17 aa, Homo sapiens
AIDAGYRHFDCAYFYHN

SEQ ID NO: 397 - protein, 12 aa, Homo sapiens
PVIKRIAKEHGK

SEQ ID NO: 398 - protein, 279 aa, Homo sapiens
IPAVGLSSWKQASPGKVTEAVKEAIDAGYRHFDCAYFYHNEREVGAGIRCKIKEGAVRREDLFIATKLWCTCHKKSLVETACRKSLKALKLNYLDLYLIHWPMGFKPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSSEGVDLIDNPVIKRIAKEHGKSPAQILIRFQIQRNVIVIPGSITPSHIKENIQVFDFELTQHDMDNILSLNRNL

SEQ ID NO: 399 - protein, 17 aa, Homo sapiens
AIDAGYRHFDCAYFYHN

SEQ ID NO: 400 - protein, 107 aa, Homo sapiens
IPAVGLSSWKQASPGKVTEAVKEAIDAGYRHFDCAYFYHNEREVGAGIRCKIKEGAVRREDLFIATKLWCTCHKKSLVETACRKGLKALKLNYLDLYLIHWPMGFKP

SEQ ID NO: 401 - protein, 62 aa, Homo sapiens
PLDESNMVIPSDTDFLDTWEAMEDLVITGLVKNIGVSNFNHEQLERLLNKPGLRFKPLTNQI

SEQ ID NO: 402 - protein, 48 aa, Homo sapiens
LIRFQIQRNVIVIPGSITPSHIKENIQVFDFELTQHDMDNILSLNRNL

SEQ ID NO: 403 - protein, 93 aa, Homo sapiens
LATVYVDVLKDSVTSTFSKLREQLGPVTQEFWDNLEKETEGLRQEMSKDLEEVKAKVQPYLDDFQKKWQEEMELYRQKVEPLRAELQEGARQK

SEQ ID NO: 404 - protein, 237 aa, Homo sapiens
KAAVLTLAVLFLTGSQARHFWQQDEPPQSPWDRVKDLATVYVDVLKDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLN

SEQ ID NO: 405 - protein, 93 aa, Homo sapiens; identical to SEQ ID NO: 403

SEQ ID NO: 406 - protein, 204 aa, Homo sapiens
KAAVLTLAVLFLTGSQARHFWQQDEPPQSPWDRVKDLATVYVDVLKDSVTSTFSKLREQLGPVTQEFWDNLEKETEGLRQEMSKDLEEVKAKVQPYLDDFQKKWQEEMELYRQKVEPLRAELQEGARQKLHELRQRLAERLEALKENGGARLAEYHAKATEHLSTLSEKAKPALEDLRQGLLPVLESFKVSFLSALEEYTKKLN

SEQ ID NO: 407 - protein, 70 aa, Homo sapiens
HSSVGAKDLVCSKMSRAKDAVSSGVASVVDVAKGVVQGGLDTTRSALTGTKEVVSSGVTGAMDMAKGAVQ

SEQ ID NO: 408 - protein, 74 aa, Homo sapiens
NVAKGTIQTGVDTTKTVLTGTKNTVCSGVTGAVNLAKEAIQGGLDTTKSMVMGTKDTMSTGLTGAANVAKGAMQ

SEQ ID NO: 409 - protein, 74 aa, Homo sapiens
GTVQTGVDTTKTVLTGTKDTVCSGVTSAVNVAKGAVQGGLDTTKSVVIGTKDTMSTGLTGAANVAKGAVQTGVD

SEQ ID NO: 410 - protein, 92 aa, Homo sapiens
GAVQMGVDTAKTVLTGTKDTVCSGVTGAANVAKGAVQTGLKTTQNIATGTKNTLGSGVTGAAKVAKGAVQGGLDTTKSVLTGTKDAVSTGLT

SEQ ID NO: 411 - protein, 366 aa, Homo sapiens
LDTTKSVLTGTKDAVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTAQLAASQPGPKVLSAEQGSYFVRLGDLGPSFRQRAFEHAVSHLQHGQFQARDTLAQLQDCFRLIEKAQQAPEGQPRLDQGSGASAEDAAVQERVCGLLRQLHTAYSGLVSSLQGLPAELQQPVGRARHSLCELYGIVASAGSVEELPAERLVQSREGVHQAWQGLEQLLEGLQHNP

What is claimed is:

1. An isolated polynucleotide comprising a nucleic acid sequence encoding the polypeptide of SEQ ID NO: 38.

2. A vector comprising the nucleic acid sequence of claim 1.

3. The vector of claim 2, further comprising a promoter operably-linked to said nucleic acid molecule.

4. A composition comprising the polynucleotide of claim 1 and a carrier.

5. An isolated polynucleotide comprising the nucleic acid sequence of SEQ ID NO: 38.

6. An isolated polynucleotide comprising a nucleic acid sequence that is the full length complement of the polynucleotide of SEQ ID NO:37.

7. An isolated polynucleotide consisting of a nucleic acid sequence encoding the polypeptide of SEQ ID NO: 38.

* * * * *